US009617557B2

(12) United States Patent
Reuzeau et al.

(10) Patent No.: US 9,617,557 B2
(45) Date of Patent: Apr. 11, 2017

(54) PLANTS HAVING INCREASED YIELD-RELATED TRAITS BY EXPRESSING A GROWTH-REGULATING FACTOR (GRF) POLYPEPTIDE AND METHOD FOR MAKING THE SAME

(75) Inventors: Christophe Reuzeau, Tocan Saint Apre (FR); Ana Isabel Sanz Molinero, Gentbrugge (BE); Valerie Frankard, Waterloo (BE); Ramon Serrano Salom, Valencia (ES); José Miguel Mulet Salort, Valencia (ES)

(73) Assignee: BASF Plant Science GmbH, Ludwigshafen (DE)

( * ) Notice: Subject to any disclaimer, the term of this patent is extended or adjusted under 35 U.S.C. 154(b) by 488 days.

(21) Appl. No.: 12/677,844

(22) PCT Filed: Sep. 15, 2008

(86) PCT No.: PCT/EP2008/062232
§ 371 (c)(1),
(2), (4) Date: Mar. 12, 2010

(87) PCT Pub. No.: WO2009/034188
PCT Pub. Date: Mar. 19, 2009

(65) Prior Publication Data
US 2011/0061133 A1 Mar. 10, 2011

Related U.S. Application Data

(60) Provisional application No. 60/975,877, filed on Sep. 28, 2007, provisional application No. 60/975,900, filed on Sep. 28, 2007, provisional application No. 60/975,887, filed on Sep. 28, 2007, provisional application No. 60/976,835, filed on Oct. 2, 2007, provisional application No. 60/977,121, filed on Oct. 3, 2007.

(30) Foreign Application Priority Data

| Sep. 14, 2007 | (EP) | 07116515 |
| Sep. 14, 2007 | (EP) | 07116516 |
| Sep. 14, 2007 | (EP) | 07116520 |
| Sep. 21, 2007 | (EP) | 07116961 |
| Sep. 28, 2007 | (EP) | 07117490 |

(51) Int. Cl.
*C12N 15/82* (2006.01)
*C07K 14/415* (2006.01)

(52) U.S. Cl.
CPC ........ *C12N 15/8261* (2013.01); *C07K 14/415* (2013.01)

(58) Field of Classification Search
USPC ................................................ 800/278, 290
See application file for complete search history.

(56) References Cited

U.S. PATENT DOCUMENTS

| 7,141,423 B2* | 11/2006 | Thomas et al. | 435/419 |
| 2003/0233675 A1* | 12/2003 | Cao et al. | 800/279 |
| 2004/0123343 A1 | 6/2004 | La Rosa et al. | |
| 2006/0048240 A1 | 3/2006 | Alexandrov et al. | |
| 2007/0022495 A1* | 1/2007 | Reuber et al. | 800/279 |
| 2008/0090998 A1 | 4/2008 | Abad et al. | |

FOREIGN PATENT DOCUMENTS

| WO | WO-99/29881 A1 | 6/1999 |
| WO | WO-01/85946 A2 | 11/2001 |
| WO | WO-03/008540 A2 | 1/2003 |
| WO | WO-2006/131547 A1 | 12/2006 |
| WO | WO-2007/027866 A2 | 3/2007 |
| WO | WO-2007/051866 A2 | 5/2007 |
| WO | WO-2007/064724 A2 | 6/2007 |

OTHER PUBLICATIONS

Kim et al. The AtGRF family of putative transcription factors is involved in leaf and cotyledon growth in Arabidopsis. Plant J. Oct. 2003;36(1):94-104.*
Horiguchi et al. The transcription factor AtGRF5 and the transcription coactivator AN3 regulate cell proliferation in leaf primordia of Arabidopsis thaliana. Plant J. Jul. 2005;43(1):68-78.*
Ferjani et al. Analysis of leaf development in fugu mutants of Arabidopsis reveals three compensation modes that modulate cell expansion in determinate organs. Plant Physiol. Jun. 2007;144(2):988-99.*
Carey A.T. at et al. Down-regulation of a ripening-related beta-galactosidase gene (TBG1) in transgenic tomato fruits. J Exp Bot. Apr. 2001;52(357):663-8.*
Tani et al. Activation tagging in plants: a tool for gene discovery. Funct Integr Genomics. Oct. 2004;4(4):258-66. Epub May 20, 2004.*
Sjolander. Phylogenomic inference of protein molecular function: advances and challenges. Bioinformatics. Jan. 22, 2004;20(2):170-9.*
"Expressed protein [Oryza sativa Japonica Group]", Database GenBank Accession No. AAX96767, dated Apr. 28, 2005.
"Expressed protein (with alternative splicing) [Oryza sativa Japonica Group]", Database GenBank Accession No. AAR87203, dated Jan. 1, 2004.

(Continued)

Primary Examiner — Cynthia Collins
(74) Attorney, Agent, or Firm — Drinker Biddle & Reath LLP

(57) ABSTRACT

The present invention relates generally to the field of molecular biology and concerns a method for increasing various plant yield-related traits by increasing expression in a plant of a nucleic acid encoding a GRF polypeptide. The present invention also concerns plants having increased expression of a nucleic acid encoding a GRF polypeptide, which plants have increased yield-related traits relative to control plants. The invention also provides constructs useful in the methods of the invention.

21 Claims, 210 Drawing Sheets

(56) References Cited

OTHER PUBLICATIONS

Ge, et al., "Overexpression of *OsRAA1* Causes Pleiotropic Phenotypes in Transgenic Rice Plants, including Altered Leaf, Flower, and Root Development and Root Response to Gravity", Plant Physiology, vol. 135, (2004), pp. 1502-1513.

"OSJNBa0041A02.20 [Oryza sativa Japonica Group]", Database GenBank Accession No. CAE01827, dated Apr. 16, 2005.

"RAA1 [Oryza sativa Japonica Group]", Database GenBank Accession No. AAT94064, dated Aug. 14, 2004.

Jeong Hoe Kim, et al., "The AtGRF family of putative transcription factors is involved in leaf and cotyledon growth in *Arabidopsis*," The Plant Journal, 2003, vol. 36, No. 1, pp. 94-104.

* cited by examiner

FIGURE 3

SEQ ID NO: 1, Arabidopsis thaliana Arath_GRF_AT3G13960.1 nucleic acid sequence
ATGATGAGTCTAAGTGGAAGTAGCGGGAGAACAATAGGAAGGCCTCCATTTACACCAACACAATGG
GAAGAACTGGAACATCAAGCCCTAATCTACAAGTACATGGTCTCTGGTGTTCCTGTCCCACCTGAG
CTCATCTTCTCCATTAGAAGAAGCTTGGACACTTCCTTGGTCTCTAGACTCCTTCCTCACCAATCC
CTTGGATGGGGGTGTTACCAGATGGGATTTGGGAGAAAACCAGATCCAGAGCCAGGAAGATGCAGA
AGAACAGATGGTAAGAAATGGAGATGCTCAAGAGAAGCTTACCCAGATTCGAAGTACTGTGAAAAA
CACATGCACAGAGGAAGAAACCGTGCCAGAAAATCTCTTGATCAGAATCAGACAACAACAACTCCT
TTAACATCACCATCTCTCTCATTCACCAACAACAACAACCCAAGTCCCACCTTGTCTTCTTCTTCT
TCCTCTAATTCCTCTTCTACTACTTATTCTGCTTCTTCTTCTTCAATGGATGCCTACAGTAACAGT
AATAGGTTTGGGCTTGGTGGAAGTAGTAGTAACACTAGAGGTTATTTCAACAGCCATTCTCTTGAT
TATCCTTATCCTTCTACTTCACCCAAACAACAACAACAAACTCTTCATCATGCTTCCGCTTTGTCA
CTTCATCAAAATACTAATTCTACTTCTCAGTTCAATGTCTTAGCCTCTGCTACTGACCACAAAGAC
TTCAGGTACTTTCAAGGGATTGGGGAGAGAGTTGGAGGAGTTGGGGAGAGAACGTTCTTTCCAGAA
GCATCTAGAAGCTTTCAAGATTCTCCATACCATCATCACCAACAACCGTTAGCAACAGTGATGAAT
GATCCGTACCACCACTGTAGTACTGATCATAATAAGATTGATCATCATCACACATACTCATCCTCA
TCATCATCTCAACATCTTCATCATGATCATGATCATAGACAGCAACAGTGTTTTGTTTGGGCGCC
GACATGTTCAACAAACCTACAAGAAGTGTCCTTGCAAACTCATCAAGACAAGATCAAAATCAAGAA
GAAGATGAGAAAGATTCATCAGAGTCGTCCAAGAAGTCTCTACATCACTTCTTTGGTGAGGACTGG
GCACAGAACAAGAACAGTTCAGATTCTTGGCTTGACCTTTCTTCCCACTCAAGACTCGACACTGGT
AGCTAA

SEQ ID NO: 2, Arabidopsis thaliana Arath_GRF_AT3G13960.1 translated polypeptide sequence
MMSLSGSSGRTIGRPPFTPTQWEELEHQALIYKYMVSGVPVPPELIFSIRRSLDTSLVSRLLPHQS
LGWGCYQMGFGRKPDPEPGRCRRTDGKKWRCSREAYPDSKYCEKHMHRGRNRARKSLDQNQTTTTP
LTSPSLSFTNNNNPSPTLSSSSSSNSSSTTYSASSSSMDAYSNSNRFGLGGSSSNTRGYFNSHSLD
YPYPSTSPKQQQQTLHHASALSLHQNTNSTSQFNVLASATDHKDFRYFQGIGERVGGVGERTFFPE
ASRSFQDSPYHHHQQPLATVMNDPYHHCSTDHNKIDHHHTYSSSSSSQHLHHDHDHRQQQCFVLGA
DMFNKPTRSVLANSSRQDQNQEEDEKDSSESSKKSLHHFFGEDWAQNKNSSDSWLDLSSHSRLDTG
S

SEQ ID NO: 3, Arabidopsis thaliana Arath_GRF_At2G06200 nucleic acid sequence
ATGGCTACAAGGATTCCATTCACAGAATCACAATGGGAAGAACTTGAAAACCAAGCTCTTGTGTTC
AAGTACTTAGCTGCAAATATGCCTGTTCCACCTCATCTTCTCTTCCTCATCAAAAGACCCTTTCTC
TTCTCTTCTTCTTCTTCATCTTCTTCTTCAAGCTTCTTCTCTCCCACTCTTTCTCCACACTTT
GGGTGGAATGTGTATGAGATGGAATGGGAAGAAAGATAGATGCAGAGCCAGGAAGATGTAGAAGA
ACTGATGGCAAGAAATGGAGATGCTCTAAAGAAGCTTACCCTGACTCTAAGTACTGTGAGAGACAT
ATGCATAGAGGCAAGAACCGTTCTTCCTCAAGAAAGCCTCCTCCTACTCAATTCACTCCAAATCTC
TTTCTCGACTCTTCTTCCAGAAGAAGAAGAAGTGGATACATGGATGATTTCTTCTCCATAGAACCT
TCCGGGTCAATCAAAAGCTGCTCTGGCTCAGCAATGGAAGATAATGATGATGGCTCATGTAGAGGC
ATCAACAACGAGGAGAAGCAGCCGGATCGACATTGCTTCATCCTTGGTACTGACTTGAGGACACGT
GAGAGGCCATTGATGTTAGAGGAGAAGCTGAAACAAAGAGATCATGATAATGAAGAAGAGCAAGGA
AGCAAGAGGTTTTATAGGTTTCTTGATGAATGGCCTTCTTCTAAATCTTCTGTTTCTACTTCACTC
TTCATTTGA

FIGURE 5

SEQ ID NO: 4, Arabidopsis thaliana Arath_GRF_At2G06200 translated polypeptide sequence
MATRIPFTESQWEELENQALVFKYLAANMPVPPHLLFLIKRPFLFSSSSSSSSSSSFFSPTLSPHF
GWNVYEMGMGRKIDAEPGRCRRTDGKKWRCSKEAYPDSKYCERHMHRGKNRSSSRKPPPTQFTPNL
FLDSSSRRRRSGYMDDFFSIEPSGSIKSCSGSAMEDNDDGSCRGINNEEKQPDRHCFILGTDLRTR
ERPLMLEEKLKQRDHDNEEEQGSKRFYRFLDEWPSSKSSVSTSLFI

SEQ ID NO: 5, Arabidopsis thaliana Arath_GRF_At2G22840 nucleic acid sequence
ATGGATCTTGGAGTTCGTGTTTCTGGTCATGAAACCGTTTCTTCTCCGGGTCAAACTGAACTCGGA
TCTGGTTTCAGTAACAAGCAAGAAAGATCCGGTTTCGATGGTGAAGATTGCTGGAGAAGTTCAAAG
CTCTCACGAACATCAACTGATGGATTCTCTTCTTCCCCTGCCTCTGCTAAAACGCTGTCGTTTCAT
CAAGGCATCCCTTTACTGAGATCTACCACTATTAATGATCCTCGTAAAGGACAAGAACACATGCTT
AGCTTCTCTTCTGCTTCAGGCAAATCAGATGTCTCACCTTATCTTCAGTACTGTAGAAACTCAGGA
TATGGTTTAGGAGGAATGATGAACACAAGCAACATGCATGGAAACTTGTTGACAGGAGTAAAAGGA
CCTTTTTCATTGACTCAGTGGGCAGAGCTAGAGCAACAGGCGTTGATCTATAAGTATATCACAGCC
AATGTCCCTGTTCCATCTAGTTTACTTCTCTCTCTCAAGAAATCTTTTTTCCCTTATGGTTCCTTG
CCTCCTAATTCTTTTGGATGGGGCTCTTTTCATCTGGGCTTTTCCGGTGGTAACATGGATCCCGAG
CCAGGGAGATGTCGCCGGACAGATGGAAAGAAATGGCGGTGCTCGAGGGACGCTGTTCCCGATCAA
AAGTACTGTGAACGACATATTAACAGAGGCCGCCATCGTTCAGAAAGCCTGTGGAAGGCCAAAAT
GGCCACAATACTAATGCTGCCGCCGCTGCTTCTGCTGCTGCCGCTTCTACCGCTGCTGCTGTGTCC
AAAGCGGCAGCGGGGACTTCAGCTGTTGCGATGCGTGGATCAGATAATAACAATAGCCTTGCCGCT
GCTGTTGGAACACAACATCATACCAATAATCAATCTACAGATTCTTTGGCTAACAGAGTTCAAAAT
TCTCGAGGGGCTTCGGTTTTTCCTGCCACGATGAACTTACAGTCGAAGGAAACTCATCCGAAACAA
AGCAATAATCCCTTTGAATTCGGACTCATCTCTTCTGATTCGTTACTTAATCCGTCGCATAAACAA
GCCTCGTATGCAACCTCTTCCAAAGGCTTTGGATCGTATCTTGACTTCGGCAACCAAGCCAAGCAC
GCGGGGAATCACAACAATGTCGATTCTTGGCCCGAAGAGCTGAAATCGGATTGGACTCAGCTCTCA
ATGTCAATCCCTATGGCTCCATCTTCCCCTGTTCAAGATAAACTTGCACTCTCACCTTTAAGGTTA
TCGCGTGAGTTTGACCCCGCGATCCACATGGGATTAGGCGTCAACACCGAGTTTCTTGACCCCGGG
AAAAAGACGAATAACTGGATACCAATCTCCTGGGGTAATAACAACTCCATGGGAGGTCCACTCGGC
GAGGTACTAAACAGCACGACCAATAGTCCCAAGTTTGGTTCCTCTCCAACAGGCGTCTTGCAAAAG
TCGACATTTGGTTCTCTTTCTAACAGCAGCTCGGCAAGCAGCACCATCATTGGCGATAACAACAAT
AAGAACGGTGATGGAAAAGATCCGCTTGGCCCGACCACGCTGATGAATACTTCTGCTACTGCTCCT
TCTCTGTGA

SEQ ID NO: 6, Arabidopsis thaliana Arath_GRF_At2G22840 translated polypeptide sequence
MDLGVRVSGHETVSSPGQTELGSGFSNKQERSGFDGEDCWRSSKLSRTSTDGFSSSPASAKTLSFH
QGIPLLRSTTINDPRKGQEHMLSFSSASGKSDVSPYLQYCRNSGYGLGGMMNTSNMHGNLLTGVKG
PFSLTQWAELEQQALIYKYITANVPVPSSLLLSLKKSFFPYGSLPPNSFGWGSFHLGFSGGNMDPE
PGRCRRTDGKKWRCSRDAVPDQKYCERHINRGRHRSRKPVEGQNGHNTNAAAAASAAAASTAAAVS
KAAAGTSAVAMRGSDNNSLAAAVGTQHHTNNQSTDSLANRVQNSRGASVFPATMNLQSKETHPKQ
SNNPFEFGLISSDSLLNPSHKQASYATSSKGFGSYLDFGNQAKHAGNHNNVDSWPEELKSDWTQLS
MSIPMAPSSPVQDKLALSPLRLSREFDPAIHMGLVNTEFLDPGKKTNNWIPISWGNNNSMGGPLG
EVLNSTTNSPKFGSSPTGVLQKSTFGSLSNSSSASSTIIGDNNNKNGDGKDPLGPTTLMNTSATAP
SL

FIGURE 5 (continued)

SEQ ID NO: 7, Arabidopsis thaliana Arath_GRF_At2G36400 nucleic acid sequence
ATGGATTTGCAACTGAAACAATGGAGAAGCCAGCAGCAGCAACAACATCAGACAGAGTCAGAAGAA
CAACCTTCTGCAGCTAAGATACCAAAACATGTCTTTGACCAGATTCATTCTCACACTGCAACTTCT
ACTGCTCTTCCTCTCTTTACCCCTGAGCCTACTTCTTCTAAACTCTCCTCTTTGTCTCCTGATTCT
TCCTCCAGGTTCCCCAAGATGGGGAGCTTCTTTAGCTGGGCACAGTGGCAAGAACTTGAACTACAA
GCTCTGATCTACAGGTACATGTTGGCTGGTGCTGCTGTTCCTCAGGAGCTCCTTTTACCAATCAAG
AAAAGCCTTCTCCATCTATCTCCTTCCTACTTTCTTCACCATCCTCTTCAACACCTACCTCATTAC
CAACCTGCTTGGTATTTGGGAAGGGCAGCGATGGATCCTGAGCCAGGCAGATGCAGGAGAACGGAT
GGTAAGAAGTGGAGATGTTCAAGAGACGTCTTCGCTGGCCACAAGTATTGCGAGCGCCACATGCAC
CGTGGCCGCAACCGTTCAAGAAAGCCTGTGGAAACTCCAACCACCGTCAATGCAACTGCCACGTCC
ATGGCTTCATCAGTAGCAGCCGCAGCCACCACTACAACAGCAACAACAACATCTACGTTTGCTTTT
GGTGGTGGTGGTGGTAGTGAGGAAGTGGTTGGTCAAGGAGGATCTTTCTTCTTCTCTGGCTCTTCT
AACTCTTCATCTGAACTTCTCCACCTTAGTCAAAGTTGTTCGGAGATGAAGCAAGAAAGCAACAAC
ATGAACAACAAGAGGCCATACGAGTCCCACATCGGATTCAGTAACAACAGATCAGATGGAGGACAC
ATCCTGAGGCCCTTCTTTGACGATTGGCCTCGTTCTTCGCTCCAAGAAGCTGACAATAGTTCAAGC
CCCATGAGCTCAGCCACTTGTCTCTCCATCTCCATGCCCGGGAACTCTTCCTCAGACGTCTCTCTG
AAGCTGTCCACAGGCAACGAAGAGGGAGCCCGGAGCAACAACAATGGGAGAGATCAGCAAAACATG
AGCTGGTGGAGCGGTGGAGGTTCCAACCACCATCATCACAACATGGGCGGACCATTGGCCGAAGCC
CTGAGATCTTCTTCCTCATCTTCCCCAACCAGTGTTCTCCATCAGCTTGGTGTCTCGACACAAGCC
TTTCATTGA

SEQ ID NO: 8, Arabidopsis thaliana Arath_GRF_At2G36400 translated polypeptide sequence
MDLQLKQWRSQQQQQHQTESEEQPSAAKIPKHVFDQIHSHTATSTALPLFTPEPTSSKLSSLSPDS
SSRFPKMGSFFSWAQWQELELQALIYRYMLAGAAVPQELLLPIKKSLLHLSPSYFLHHPLQHLPHY
QPAWYLGRAAMDPEPGRCRRTDGKKWRCSRDVFAGHKYCERHMHRGRNRSRKPVETPTTVNATATS
MASSVAAAATTTTATTTSTFAFGGGGGSEEVVGQGGSFFFSGSSNSSSELLHLSQSCSEMKQESNN
MNNKRPYESHIGFSNNRSDGGHILRPFFDDWPRSSLQEADNSSSPMSSATCLSISMPGNSSSDVSL
KLSTGNEEGARSNNNGRDQQNMSWWSGGGSNHHHHNMGGPLAEALRSSSSSSPTSVLHQLGVSTQA
FH

SEQ ID NO: 9, Arabidopsis thaliana Arath_GRF_At2G45480 nucleic acid sequence
ATGCAGAGCCCTAAAATGGAGCAGGAGGAGGTTGAGGAGGAGAGGATGAGGAATAAGTGGCCGTGG
ATGAAGGCGGCGCAGTTAATGGAGTTTCGGATGCAAGCTTTGGTGTATAGATACATAGAGGCTGGT
CTCCGTGTGCCTCATCATCTCGTGGTGCCTATTTGGAACAGTCTTGCTCTCTCTTCTTCCTCCAAT
TACAACTATCACTCTTCTTCTCTGTTGAGTAACAAGGGAGTAACCCATATCGACACGTTGGAAACT
GAACCAACTAGGTGCAGGAGAACAGATGGGAAGAAATGGCGCTGTAGCAACACGGTCCTTCTATTC
GAGAAGTACTGTGAACGGCACATGCATAGAGGTCGTAAACGTTCAAGAAAGCTTGTGGAATCTTCT
TCTGAGGTTGCTTCATCATCAACCAAATACGACAACACTTATGGTTTGGATAGGTATAACGAGAGT
CAGAGTCATCTTCATGGGACAATCTCGGGTTCTAGTAATGCGCAGGTAGTTACCATTGCTTCACTG
CCTAGTGCCAGATCCTGTGAAAATGTCATTCGTCCGTCTTTAGTGATCTCTGAATTCACAAACAAA
AGTGTGAGTCACGGCAGAAAGAACATGGAGATGAGTTATGATGACTTTATTAATGAAAAAGAGGCG
AGTATGTGTGTTGGAGTTGTTCCTCTTCAAGGTGATGAGAGCAAACCTTCGGTTCAAAAGTTCTTC
CCTGAGGTATCTGATAAATGCTTAGAAGCTGCAAAATTCTCAAGCAACAGGAAGAATGATATAATT
GCAAGAAGCAGAGAATGGAAGAATATGAATGTTAATGGTGGTTTGTTTCATGGTATCCACTTTTCT
CCAGACACTGTTCTTCAAGAACGTGGTTGTTTTCGTTTACAAGGAGTTGAAACAGACAATGAACCA

```
GGAAGGTGCCGAAGAACAGATGGGAAGAAGTGGAGATGCAGCAAAGATGTTTTGTCTGGTCAGAAG
TACTGCGATAAGCACATGCATAGAGGTATGAAGAAGAAGCATCCAGTTGATACTACTAACTCACAT
GAGAATGCCGGGTTTAGCCCGTTAACCGTGGAAACAGCTGTTAGATCGGTTGTGCCTTGCAAAGAT
GGAGATGACCAGAAGCATTCTGTTTCAGTCATGGGAATTACACTGCCCCGAGTTTCTGATGAGAAG
AGCACTAGCAGTTGCAGTACCGACACTACCATTACTGACACAGCTTTAAGGGGTGAAGACGACGAT
GAGGAGTACTTGTCTTTGTTTTCACCAGGTGTTTAG
```

SEQ ID NO: 10, Arabidopsis thaliana Arath_GRF_At2G45480 translated polypeptide sequence
```
MQSPKMEQEEVEEERMRNKWPWMKAAQLMEFRMQALVYRYIEAGLRVPHHLVVPIWNSLALSSSSN
YNYHSSSLLSNKGVTHIDTLETEPTRCRRTDGKKWRCSNTVLLFEKYCERHMHRGRKRSRKLVESS
SEVASSSTKYDNTYGLDRYNESQSHLHGTISGSSNAQVVTIASLPSARSCENVIRPSLVISEFTNK
SVSHGRKNMEMSYDDFINEKEASMCVGVVPLQGDESKPSVQKFFPEVSDKCLEAAKFSSNRKNDII
ARSREWKNMNVGGLFHGIHFSPDTVLQERGCFRLQGVETDNEPGRCRRTDGKKWRCSKDVLSGQK
YCDKHMHRGMKKKHPVDTTNSHENAGFSPLTVETAVRSVVPCKDGDDQKHSVSVMGITLPRVSDEK
STSSCSTDTTITDTALRGEDDDEEYLSLFSPGV
```

SEQ ID NO: 11, Arabidopsis thaliana Arath_GRF_AT3G52910.1 nucleic acid sequence
```
ATGGACTTGCAACTGAAACAATGGAGAAGTCAGCAGCAGAATGAGTCAGAAGAACAAGGCTCTGCT
GCAACTAAGATATCAAACTTTTTCTTTGATCAGATTCAGTCCCAAACTGCTACTTCTGCTGCTGCG
GCTCCTCTTCCTCTCTTTGTCCCTGAACCCACTTCTTCCTCTTCTTTCTCTTGCTTCTCTCCTGAC
TCTTCTAATTCTTCTTCTTCTTCCAGGTTCCTCAAGATGGGAAACTTCTTCAGCTGGGCACAGTGG
CAAGAACTTGAGCTACAAGCACTGATCTATAGATACATGTTGGCTGGTGCTTCTGTTCCTCAAGAG
CTTCTCTTACCTATTAAGAAAAGTCTCCTCCATCAATCTCCTATGCATTTCCTTCACCATCCTCTT
CAACATAGTTTTCCTCATCACCAACCTTCTTGGTATTGGGGAAGAGGAGCAATGGATCCTGAGCCA
GGGAGGTGTAAGAGAACTGACGGCAAGAAATGGAGATGTTCAAGGGATGTTGTAGCGGGCCACAAG
TATTGTGACCGCCACATTCACCGTGGAAGAAACCGTTCAAGAAAGCCTGTGGAAACCGCCACAACC
ACCATCACAACGACAGCCACAACAACCGCATCTTCTTTTGTCTTAGGTGAGGAGCTTGGTCATGGA
CCAAACAACAACCACTTCTTCTCCTCTGGTTCATCTCAACCTCTCCACCTTAGTCATCAACAAAGT
TGTTCTTCAGAGATGAAACAAGAAAGCAACAACAACAAGAGGCCATATGAAGCTAACAGTGGATTC
AGCAATGGAAGATCAGACGATGGTCACATCTTGAGGCATTTCTTTGACGATTGGCCACGATCATCA
GACTCTACCTCCAGTCCAATGAGCTCATCCACTTGTCATCTTTCAATCTCCATGCCCGGTAACAAC
ACGTCCTCAGATGTTTCTCTAAAACTTTCCACAGGCAATGAAGAAGAAGAAGAGAACATGAGAAAT
AACAACAATGAGAGGGAGCAAATGAATTGGTGGAGCAATGGAGGGAATCACCACAACAATATGGGA
GGACCATTAGCTGAGGCTTTGAGGTCAGCTTCTTCGACGTCAAGTGTTCTTCATCAGATGGGAATC
TCTACTCAAGAAATGAAGTATGTGAAGCCATTGAGCTTATTGGGTAATGCGCTGAAGACCAAAGTG
TCAGTCCCTGGTCGGTTCTGGGTTTAGATGTTGGTGATAAGTATGTTGGATTAGCTATCTCAGAT
CCTTCAAATATGGTTGCTTCTCCATTGAGTGTTTTGCTCAGAAAGAAATCAAACATTGACCTGATG
GCTACAGATTTCCAGAACCTGGTCAAAGCATTTTCTGTGTCGGGATTAGTCGTTGGTTATCCATTT
GGCAAACTGAACAATGTAGAGGATGTTGTCACTGTGAATCTTTTCATTGAGGAACTTCGTAAGACC
GAAAAACTCAAGGATGTGAAATACACATATTGGGACGAGCGATTATCATCAAAGACCGTTGAACTG
ATGTTGAAGCCCTTGAATTTGCATCCTGTTCAAGAGAAGACAATGTTGGACAAGTTAGCCGCAGTA
GTTATACTTCAGGAGTATTTAGATTACGCGAACAGGTATGTAAACACTGAGCCAGCAGAGTAA
```

SEQ ID NO: 12, Arabidopsis thaliana Arath_GRF_AT3G52910 translated polypeptide sequence
MDLQLKQWRSQQQNESEEQGSAATKISNFFFDQIQSQTATSAAAAPLPLFVPEPTSSSSFSCFSPD
SSNSSSSSRFLKMGNFFSWAQWQELELQALIYRYMLAGASVPQELLLPIKKSLLHQSPMHFLHHPL
QHSFPHHQPSWYWGRGAMDPEPGRCKRTDGKKWRCSRDVVAGHKYCDRHIHRGRNRSRKPVETATT
TITTTATTTASSFVLGEELGHGPNNNHFFSSGSSQPLHLSHQQSCSSEMKQESNNNKRPYEANSGF
SNGRSDDGHILRHFFDDWPRSSDSTSSPMSSSTCHLSISMPGNNTSSDVSLKLSTGNEEEEENMRN
NNNEREQMNWWSNGGNHHNNMGGPLAEALRSASSTSSVLHQMGISTQEMKYVKPLSLLGNALKTKV
SVPGRFLGLDVGDKYVGLAISDPSNMVASPLSVLLRKKSNIDLMATDFQNLVKAFSVSGLVVGYPF
GKLNNVEDVVTVNLFIEELRKTEKLKDVKYTYWDERLSSKTVELMLKPLNLHPVQEKTMLDKLAAV
VILQEYLDYANRYVNTEPAE

SEQ ID NO: 13, Arabidopsis thaliana Arath_GRF_AT4G24150.1 nucleic acid sequence
ATGAGGATGCTTCTTGGGATTCCTTACGTAGACAAGTCGGTTCTTTCCAACTCTGTTCTTGAGAGA
GGCAAGCAGGATAAAAGCAAACTATTGTTAGTCGACAAATGCCATTATGAGCTTGATGTTGAAGAA
CGCAAGGAAGATTTTGTTGGTGGGTTTGGATTTGGTGTTGTAGAAAATTCGCATAAAGACGTTATG
GTGCTACCTCATCATCACTATTATCCATCATATTCATCACCTTCCTCTTCTTCTTTGTGTTACTGT
TCTGCTGGTGTTAGCGATCCCATGTTCTCTGTTTCTAGCAATCAGGCTTACACTTCTTCTCACAGT
GGTATGTTCACACCCGCCGGTTCTGGTTCTGCTGCTGTGACTGTAGCAGATCCTTTTTTCTCCTTG
AGCTCTTCAGGGGAAATGAGAAGAAGTATGAACGAAGATGCTGGTGCAGCTTTCAGCGAAGCTCAA
TGGCATGAGCTTGAGAGGCAGAGGAATATATACAAGTACATGATGGCTTCTGTTCCTGTTCCTCCA
GAGCTTCTCACACCCTTTCCCAAGAACCACCAATCAAACACTAACCCGGATGTGGATACATATAGG
AGTGGAATGTTTAGTATTTATGCTGATTACAAGAATCTGCCGTTGTCTATGTGGATGACAGTAACT
GTGGCAGTGGCGACAGGAGGCTCATTGCAGCTGGGGATTGCTTCAAGCGCAAGCAATAACACGGCT
GATCTGGAGCCATGGAGGTGCAAGAGAACAGATGGGAAGAAATGGAGGTGCTCTAGAAACGTGATT
CCTGATCAGAAATACTGTGAGAGACACACACACAAGAGCCGTCCTCGTTCAAGAAAGCATGTGGAA
TCATCTCACCAATCATCTCACCACAATGACATTCGTACGGCTAAGAATGATACTAGCCAGCTTGTG
AGAACTTATCCTCAGTTTTACGGACAACCTATAAGCCAGATCCCTGTGCTTTCTACTCTTCCGTCT
GCCTCCTCTCCATATGATCACCACAGAGGACTGAGGTGGTTTACGAAAGAAGATGATGCCATTGGA
ACCTTAAACCCGGAGACTCAAGAAGCTGTCCAGCTGAAAGTTGGATCAAGCAGAGAGCTCAAACGG
GGATTCGATTATGATCTGAATTTCAGGCAGAAAGAGCCAATAGTAGACCAGAGCTTTGGAGCATTG
CAGGGTCTATTAAGTCTAAACCAGACACCACAACATAACCAAGAAACAAGACAGTTTGTTGTAGAA
GGAAAGCAAGATGAAGCGATGGGAAGCTCTCTGACACTCTCAATGGCTGGAGGAGGCATGGAGGAA
ACAGAGGGAACAAACCAGCATCAGTGGGTTAGCCATGAAGGTCCATCATGGCTCTATTCAACAACA
CCAGGTGGACCATTGGCTGAAGCACTGTGTCTCGGTGTCTCCAACAACCCAAGTTCTAGTACTACT
ACTAGTAGCTGCAGCAGAAGCTCAAGCTAA

SEQ ID NO: 14, Arabidopsis thaliana Arath_GRF_ AT4G24150.1 translated polypeptide sequence
MRMLLGIPYVDKSVLSNSVLERGKQDKSKLLLVDKCHYELDVEERKEDFVGGFGFGVVENSHKDVM
VLPHHHYYPSYSSPSSSSLCYCSAGVSDPMFSVSSNQAYTSSHSGMFTPAGSGSAAVTVADPFFSL
SSSGEMRRSMNEDAGAAFSEAQWHELERQRNIYKYMMASVPVPPELLTPFPKNHQSNTNPDVDTYR
SGMFSIYADYKNLPLSMWMTVTVAVATGGSLQLGIASSASNNTADLEPWRCKRTDGKKWRCSRNVI
PDQKYCERHTHKSRPRSRKHVESSHQSSHHNDIRTAKNDTSQLVRTYPQFYGQPISQIPVLSTLPS
ASSPYDHHRGLRWFTKEDDAIGTLNPETQEAVQLKVGSSRELKRGFDYDLNFRQKEPIVDQSFGAL
QGLLSLNQTPQHNQETRQFVVEGKQDEAMGSSLTLSMAGGGMEETEGTNQHQWVSHEGPSWLYSTT
PGGPLAEALCLGVSNNPSSSTTTSSCSRSSS SEQ ID NO: 15, Arabidopsis thaliana Arath_GRF_AT4G37740.1 nucleic acid sequence
ATGGATATTGGTGTTCATGTTCTTGGGTCGGTTACTAGTAATGAAAATGAGTCACTTGGTCTAAAA
GAGCTTATAGGAACTAAACAAGATAGATCCGGATTCATCGGTGAGGATTGCTTGCAACGAAGCTTG
AAGCTAGCAAGAACGACAACTAGAGCGGAAGAAGAAGAAAACTTGTCTTCTTCTGTTGCAGCTGCT
TATTGCAAAACGATGTCGTTTCACCAAGGCATTCCTCTCATGAGATCTGCTTCTCCTCTTTCCTCT
GATTCTCGCCGTCAAGAACAAATGCTTAGCTTCTCAGATAAACCAGACGCTCTTGATTTCAGTAAA
TATGTCGGTTTGGATAATAGCAGTAATAACAAGAACTCTCTCTCGCCGTTTCTTCACCAGATTCCT
CCACCTTCTTACTTTAGAAGCTCAGGAGGATATGGTTCTGGTGGAATGATGATGAACATGAGCATG
CAAGGGAACTTCACAGGTGTTAAAGGACCTTTTACATTGACTCAATGGGCTGAGTTAGAGCAACAG
GCGTTGATCTATAAGTACATCACAGCCAATGTCCCTGTTCCTTCTAGTTTGCTCATCTCTATCAAG
AAGTCTTTTTATCCTTACGGATCTTTGCCTCCTAGTTCCTTCGGATGGGGAACTTTCCATCTCGGT
TTCGCAGGCGGTAACATGGACCCTGAGCCAGGGAGATGCCGCAGAACAGATGGGAAGAAATGGCGG
TGCTCAAGAGACGCCGTTCCTGATCAGAAATACTGTGAAAGACACATCAACAGAGGCCGTCATCGT
TCAAGAAAGCCTGTGGAAGTCCAATCTGGCCAAAACCAAACCGCCGCTGCTGCATCCAAAGCGGTT
ACTACACCACAACAGCCTGTTGTCGCTGGTAATACTAACAGAAGCAATGCCCGTGCATCAAGCAAC
CGCAGCCTCGCCATTGGAAGTCAATATATCAATCCTTCTACAGAATCTTTACCTAACAACAGAGGA
GTTTCGATATATCCTTCCACCGTCAACTTACAACCCAAGGAATCTCCGGTTATTCATCAGAAACAC
AGAAACAACAACAACCCTTTTGAGTTTGGACACATATCCTCTGATTCGTTACTCAACCCGAATACC
GCAAAGACCTATGGATCATCGTTCTTGGATTTCAGCAGCAACCAAGAGAAGCATTCAGGGAATCAC
AATCACAATTCTTGGCCTGAAGAGCTGACATCAGATTGGACACAGCTCTCAATGTCAATTCCAATA
GCATCATCATCCCCTTCCTCCACACACAACAACAACAATGCTCAAGAAAAAACAACACTCTCGCCT
CTCAGGCTATCCCGCGAGCTTGACCTATCGATCCAAACCGATGAAACAACAATCGAGCCTACTGTG
AAAAAGGTGAATACTTGGATACCAATCTCATGGGGAAACTCCTTAGGAGGTCCTCTAGGTGAAGTA
CTAAACAGTACAACGAATAGTCCAACATTTGGATCTTCTCCTACAGGGGTTTTGCAAAAGTCCACA
TTTTGTTCACTCTCTAACAACAGCTCCGTGAGCAGCCCCATTGCAGAGAACAACAGACACAATGGC
GATTACTTTCATTACACAACCTGA SEQ ID NO: 16, Arabidopsis thaliana Arath_GRF_AT4G37740.1 translated polypeptide sequence
MDIGVHVLGSVTSNENESLGLKELIGTKQDRSGFIGEDCLQRSLKLARTTTRAEEEENLSSSVAAA
YCKTMSFHQGIPLMRSASPLSSDSRRQEQMLSFSDKPDALDFSKYVGLDNSSNNKNSLSPFLHQIP
PPSYFRSSGGYGSGGMMMNMSMQGNFTGVKGPFTLTQWAELEQQALIYKYITANVPVPSSLLISIK
KSFYPYGSLPPSSFGWGTFHLGFAGGNMDPEPGRCRRTDGKKWRCSRDAVPDQKYCERHINRGRHR
SRKPVEVQSGQNQTAAAASKAVTTPQQPVVAGNTNRSNARASSNRSLAIGSQYINPSTESLPNNRG
VSIYPSTVNLQPKESPVIHQKHRNNNNPFEFGHISSDSLLNPNTAKTYGSSFLDFSSNQEKHSGNH
NHNSWPEELTSDWTQLSMSIPIASSSPSSTHNNNNAQEKTTLSPLRLSRELDLSIQTDETTIEPTV
KKVNTWIPISWGNSLGGPLGEVLNSTTNSPTFGSSPTGVLQKSTFCSLSNNSSVSSPIAENNRHNG
DYFHYTT SEQ ID NO: 17, Arabidopsis thaliana Arath_GRF_AT5G53660.1 nucleic acid sequence
ATGGACTTTCTCAAAGTTTCAGACAAGACAACAATTCCATATAGAAGTGATTCTTTGTTTAGTTTG
AATCAGCAACAATACAAAGAGTCTTCTTTTGGATTCAGAGACATGGAGATTCATCCGCATCCTACT
CCATATGCAGGAAATGGACTTTTGGGTTGTTATTACTATTACCCTTTCACAAACGCACAATTGAAG
GAGCTTGAGAGACAAGCAATGATCTACAAGTACATGATCGCATCTATTCCTGTTCCTTTCGATCTA
CTTGTTTCTTCACCATCCTCTGCCTCTCCTTGTAACAATAAAAACATCGCCGGAGATTTAGAGCCG
GGAAGATGCCGGAGAACAGACGGAAAGAAATGGAGATGCGCGAAGAAGTCGTCTCTAATCACAAA FIGURE 5 (continued)

```
TACTGTGAGAAACACTTACACAGAGGTCGTCCTCGTTCAAGAAAGCATGTGGAACCTCCTTATTCT
CGCCCTAACAACAATGGTGGTTCTGTGAAAAACAGAGATCTCAAAAAGCTTCCTCAAAAGTTATCT
AGTAGTTCCATCAAAGACAAAACACTTGAGCCAATGGAGGTTTCATCATCAATCTCAAACTATAGA
GACTCCAGAGGAAGTGAGAAATTTACTGTATTGGCAACAACAGAGCAAGAGAACAAGTATCTGAAT
TTCATAGATGTATGGTCCGATGGAGTAAGATCATCTGAAAAACAGAGTACAACTTCAACACCTGTT
TCTTCTTCCAATGGCAATCTCTCTCTTTACTCGCTTGATCTCTCAATGGGAGGAAACAACTTAATG
GGCCAAGACGAAATGGGCCTGATACAAATGGGCTTAGGTGTAATCGGGTCGGGTAGTGAGGATCAT
CACGGGTATGGTCCTTATGGTGTGACTTCTTCACTAGAGGAGATGTCAAGCTGGCTTGCTCCGATG
TCTACCACACCTGGTGGACCATTAGCGGAGATACTGAGGCCGAGTACGAATTTGGCGATCTCTGGT
GATATCGAATCGTATAGCTTGATGGAGACTCCCACTCCAAGCTCGTCCCCGTCTAGAGTGATGAAG
AAGATGACTAGTTCAGTGTCCGACGAAAGCAGCCAGGTTTAG
```

SEQ ID NO: 18, Arabidopsis thaliana Arath_GRF_AT5G53660.1 translated polypeptide sequence
```
MDFLKVSDKTTIPYRSDSLFSLNQQQYKESSFGFRDMEIHPHPTPYAGNGLLGCYYYYPFTNAQLK
ELERQAMIYKYMIASIPVPFDLLVSSPSSASPCNNKNIAGDLEPGRCRRTDGKKWRCAKEVVSNHK
YCEKHLHRGRPRSRKHVEPPYSRPNNNGGSVKNRDLKKLPQKLSSSSIKDKTLEPMEVSSSISNYR
DSRGSEKFTVLATTEQENKYLNFIDVWSDGVRSSEKQSTTSTPVSSSNGNLSLYSLDLSMGGNNLM
GQDEMGLIQMGLGVIGSGSEDHHGYGPYGVTSSLEEMSSWLAPMSTTPGGPLAEILRPSTNLAISG
DIESYSLMETPTPSSSPSRVMKKMTSSVSDESSQV
```

SEQ ID NO: 19, Aquilegia formosa x Aquilegia pubescens Aqufo_GRF nucleic acid sequence DT756681, DR946716
```
ACTTAAAAGACCAGTCTTAGCTTTCTTCATTAATTCCTACTACTGTTCTCAGTGTTGCTCTTTGAG
TTTATAGATATTTTTCTTACAATGATGATGAGTGCTAGAAACAGAAATCCTTTCACTGTAACTCAA
TGGCAAGAACTTGAACATCAAGCTCTCATTTATAAGTATATGGCTTCAGGAATGCCTATACCACCT
GATCTCATCTTCCCTATTAAGAGAAGTCTTGATTCTTCAAGATTCTTTCCTCATCAACCAATGGAT
TGGGGTTGTTTTCAGATGGGTTATGGCAGGAAAGTTGATCCAGAACCTGGAAGGTGCAGAAGAACA
GATGGAAAGAAGTGGAGATGCTCAAAGGAAGCATACCCAGACTCAAAGTACTGTGAGAGACACATG
CACAGAGGCAGAAACCGTTCAAGAAAGCCTGTGGAAGTTAATACTACATCAAATTCCTCATTACCA
CTTTCATCTTTTACCTCTAGAACTCCTTCTAGTACCATTACTTCAAATACCAACCCTTCTTCTTAT
TCCCTTTCTTCATCTCTAACATCTGACAAATCTCAGCAAGAACATCATCACCCTTATCATAACACC
CCTCTTCATTCCTTTCTCAATCCTAGTAGAACTTCTTGTTCTTCTCCTAGAACTCATAATATTGAT
TTCTCACCTCATAGCAATAACAATGCCAATTTGGTATTAGACTCTGGGTCTTACTCTAACTCTTAT
GAAGATCACAGAAACAGGTATGTTCATGGTCTAAAAGAAGAGGTAGATGAAAGAGCTTTCTTTTCA
GAAGCATCAGGAACATTAAGAAGTGTACCAGAATCAACTTTGAAAGATCCATGGCGTTTAACACCA
TTAAGAATGAGTTCTTCAACTCATAACCAACCAAAAGATGGAAATTTTTCTGATTTACAAAGAGGG
TATTCTCAGTTTCAACTCCAACATAAACAACAACAACAGCAACAAGAAGAAGAACAGCATTGTTTT
ATTTTAGGTACTGATTTCAAATCTGACAGGTTTATGAAAACTAGTACTACTACTACTGAGAAAGAA
GAATCACAACAACCACTTCGCCATTTCTTTGATGAATGGCCACCTAAGAGTAAAGATTCTTGGTTG
GGTTTAGAAGAAGATAGATCAGATCAAGGTTCACATTCAACAACTCAACTTTCAATATCTATTCCT
ATGTCTTCTCATGAGTTCTCAGTTTCAAATTCCAGAACCTAACAATAAGATGATGGTTGATTTACT
TAAAGTGGGATTATTATGGAAAGATTAATGACAACAAGGAGTTGATTCAAGGTTGGGTTCAGTGTC
TTTGTACTTGTATTGTCTTTATTTAATTGATGATGAGAAGTTTAGGTAGAGAGTGCTATGTGTTAT
TTTTTTTTTTGTTATGTGTGTGGAGTGATTGAAAAGTGTGTCTTTAAACAGTAAGATTCCTGTCTT
GTGTTTTCTTGATAGCTGTTAGAACTTTGTTTGAATGACTGATGAACAAATATTTGGGATTTGGGG
ATTTGTTTGTATCAATATTAGGTGTTTTTTCTGTCTTTTTGGCTTCTTCCATGATTGCCAAAGACC
ATTTGTTCAACCTAAAAATGATAATGAAGGGGGGGCCAATTTGATATCATGAGCTTGGTTGTCAGT
TAGGAAAG
```

SEQ ID NO: 20, Aquilegia formosa x Aquilegia pubescens Aqufo_GRF translated polypeptide sequence
MMMSARNRNPFTVTQWQELEHQALIYKYMASGMPIPPDLIFPIKRSLDSSRFFPHQPMDWGCFQMG
YGRKVDPEPGRCRRTDGKKWRCSKEAYPDSKYCERHMHRGRNRSRKPVEVNTTSNSSLPLSSFTSR
TPSSTITSNTNPSSYSLSSSLTSDKSQQEHHHPYHNTPLHSFLNPSRTSCSSPRTHNIDFSPHSNN
NANLVLDSGSYSNSYEDHRNRYVHGLKEEVDERAFFSEASGTLRSVPESTLKDPWRLTPLRMSSST
HNQPKDGNFSDLQRGYSQFQLQHKQQQQQQEEEQHCFILGTDFKSDRFMKTSTTTTEKEESQQPLR
HFFDEWPPKSKDSWLGLEEDRSDQGSHSTTQLSISIPMSSHEFSVSN SEQ ID NO: 21, Brassica napus Brana_GRF nucleic acid sequence contig of CN730217.1, ES922527
GAAGAAAGATGATGGGTCTAAGTGGAAATGGTGGGAGAACAATAGAGAGGCCTCCATTTACACCAA
CACAATGGCAAGAACTGGAGAATCAAGCCCTAATTTACAAGTACATGGTCTCAGGAGTTCCTGTCC
CACCTGAGCTCATCTTCTCCATTAGAAGAAGCTTGGACTCTTCCTTGGTCTCTAGACTCCTCCCTC
ACCAATCCATTGGGTGGGGATGCTATCAGATGGGGTTTGGTAGAAAACCAGATCCAGAACCAGGAA
GGTGCAGAAGAACAGATGGTAAGAAATGGAGATGCTCAAGAGAAGCATACCCTGATTCAAAGTACT
GTGAAAAACACATGCACAGAGGAAGGAACCGTGCCAGAAATCTATTGATCAGAATCAGACAACTG
CTCCTTTAACATCACCATCTCTCTCTTTCCCCAACAACAACAACCCAAGCCCTACCTTGTCTTCTT
CCTCCTCTACTTATTCAGCTGCTTCTTCATCTCCTTCCATTGATGCTTACAGTAATATCAATAGGC
TTGGTGTTGGTAGTAGTAACAGTAGAGGTTACTTCAACAACCATTCCCTTGACTATCCTTATCCTT
TGTCCTCACCTAAACAGCAACAACAACAGCAACAAACTCTTAGTCATGTTTCTGCTTTGTCACTTC
ATCAAAACACATCTACACCTCAGCTCAATGTCTTTGCCTCTGCAACTGACCACAAAGACTTCAGAT
ATTTTCAAGGGATTGGGGAGAGAGTTGGAGTTGGGGAAAGAACTTTTTTTCCAGAAGCTTCTAGAA
GCTTTCAAGATTCTCCATACCATCACCAACAACCGTTAGCAACGGTAGTGGATAATCCGTACGACT
GTACTACTGATCATAAGTTTGATCATCATCATACATACTCATCATCATCTCAACATCATCATCATG
ACCAAGATCATCGACAACAACAACAATGTTTTGTTTTGGGCGCCGACATGTTCAACAAACCCACAA
GAACTATCTTGGAAAACACATCGAGACAAGATTATCTTAATCAAGAAGAGGAAGAGAAAGATTCAT
CGGACACGAAGAAGTCCCTTCATCATTTCTTTGGTGAAGAGTGGACACAGAACAAGAACAGTTCAG
ATTCTTGGCTTGACCTTTCTTCCCAGTCAAGACTCGACACTGGTAGCTGATTGATGAGGCCAGATA
GCATCAGTGATGGGTCTGCACCAACACACACACAAACACGTTTGAAGGGTCACATTTCACATCTAT
TTCCGTGGAACATTGAGACAGACAAGACACTG SEQ ID NO: 22, Brassica napus Brana_GRF translated polypeptide sequence
MMGLSGNGGRTIERPPFTPTQWQELENQALIYKYMVSGVPVPPELIFSIRRSLDSSLVSRLLPHQS
IGWGCYQMGFGRKPDPEPGRCRRTDGKKWRCSREAYPDSKYCEKHMHRGRNRARKSIDQNQTTAPL
TSPSLSFPNNNNPSPTLSSSSSTYSAASSSPSIDAYSNINRLGVGSSNSRGYFNNHSLDYPYPLSS
PKQQQQQQQTLSHVSALSLHQNTSTPQLNVFASATDHKDFRYFQGIGERVGVGERTFFPEASRSFQ
DSPYHHQQPLATVVDNPYDCTTDHKFDHHHTYSSSSQHHHHDQDHRQQQQCFVLGADMFNKPTRTI
LENTSRQDYLNQEEEEKDSSDTKKSLHHFFGEEWTQNKNSSDSWLDLSSQSRLDTGS SEQ ID NO: 23, Hordeum vulgare Horvu_GRF nucleic acid sequence AK250947
GGGCAGCCGCAGCCGCAGCCGCAGCAGAGGAGAGAGAGAGGGAGGGAGAAGCATATATGGCGATGC
CCTTTGCCTCCCTGTCGCCGGCAGCCGACCACCACCGCTCCTCCCCCATCTTCCCCTTCTGCCGCT
CCTCCCCTCTCTACTCGGTAGGGGAGGAGGCGGCGCATCAGCATCCTCATCCTCAGCAGCAGCAGC
AGCAGCACGCGATGAGCGGCGCGCGGTGGGCGGCGAGGCCGGCGCCCTTCACGGCGGCGCAGTACG
AGGAGCTGGAGCAGCAGGCGCTCATCTACAAGTACCTCGTCGCCGGCGTCCCCGTCCCGCAGGACC FIGURE 5 (continued)

TCCTCCTCCCCATCCGCCGCGGCTTCGAGACCCTCGCCTCGCGCTTCTACCACCACCACGCCCTTG
GGTACGGGTCCTACTTCGGGAAGAAGCTGGATCCGGAGCCGGGGCGGTGCCGGCGGACGGACGGCA
AGAAGTGGCGGTGCTCCAAGGAGGCCGCTCAGGACTCCAAGTACTGCGAGCGCCACATGCACCGCG
GCCGCAACCGTTCAAGAAAGCCTGTGGAAACGCAGCTCGTCGCCAGCTCCCACTCCCAGTCCCAGC
AGCACGCCACCGCCGCCTTCCACAACCACTCGCCGTATCCGGCGATCGCCACTGGCGGTGGCTCCT
TCGCCCTGGGGTCTGCTCAGCTGCACATGGACACTGCTGCGCCTTACGCGACGACCGCCGGTGCTG
CCGGAAACAAAGATTTCAGGTATTCTGCCTATGGAGTGAGGACGTCGGCGATCGAGGAGCACAACC
AGTTCATCACCGCGGCCATGGACACCGCCATGGACAACTACTCGTGGCGCCTGATGCCGTCCCAGG
CCTCGGCATTCTCGCTCTCCAGCTACCCCATGCTGGGCACGCTGAGCGACCTGGACCAGAGCGCGA
TCTGCTCGCTGGCCAAGACTGAGAGGGAGCCACTGTCCTTCTTCGGCGGCGGCGGCGACTTCGACG
ACGACTCGGCTGCGGTGAAGCAGGAGAACCAGACGCTGCGGCCCTTCTTCGACGAGTGGCCCAAGG
ACAGGGACTCGTGGCCGGAGCTGCAAGACCACGACGCCAACAACAACAGCAACGCCTTCTCAGCCA
CCAAGCTGTCCATCTCCATGCCGGTCACCAGCTCCGACTTCTCTGGCACCACCGCCGGCTCCCGCT
CGCCCAACGGTATATACTCCCGGTGAACGGCGTCGGCCGGCCTGATCTCTGCTGATTTGCCGTGGT
CACGACGGGCGTCCTCAAATCATCACAGATGAGCGAACCGGCCGACCCGATCGAATGTGTCTGTGA
GCCGACTGCAGCTTGCTTGCTCATTTTGTATGGATCGTCGTGCAGCAGGAACGAAACACTACTCCT
TTAATTTCCTTTCTTTAATTTCACAACGTTTTTTCTGGGTTTTGCCGTGTATCGGCCGGAACTGTA
CTACCAAGTTTTCTATAGCCTCGATGGTCATGCACGACATCGTTGACTGTTTCCCGCGCACTTACT
GTTGAAATAATCTTCCATTTTTGGCAAAAAAAAAAAAAAAA

SEQ ID NO: 24, Hordeum vulgare Horvu_GRF translated polypeptide sequence
MAMPFASLSPAADHHRSSPIFPFCRSSPLYSVGEEAAHQHPHPQQQQQQHAMSGARWAARPAPFTA
AQYEELEQQALIYKYLVAGVPVPQDLLLPIRRGFETLASRFYHHHALGYGSYFGKKLDPEPGRCRR
TDGKKWRCSKEAAQDSKYCERHMHRGRNRSRKPVETQLVASSHSQSQQHATAAFHNHSPYPAIATG
GGSFALGSAQLHMDTAAPYATTAGAAGNKDFRYSAYGVRTSAIEEHNQFITAAMDTAMDNYSWRLM
PSQASAFSLSSYPMLGTLSDLDQSAICSLAKTEREPLSFFGGGGDFDDDSAAVKQENQTLRPFFDE
WPKDRDSWPELQDHDANNNSNAFSATKLSISMPVTSSDFSGTTAGSRSPNGIYSR

SEQ ID NO: 25, Lycopersicon esculentum Lyces_GRF nucleic acid sequence BT013977
GATGATAAGAAACACACAAATGACTTAACTTTGCAGGTTTCACCGCACTCGACACTGCAAAAAGA
TACATATAAAAAAAAAGGTCCACTCAACTCTCTGCAAAAATAAAAAAAATTAAAAACTTTTGTCCA
AGACTTAACTTTCTCTTCAGAAATAAATTTGCCTTCACATTAATATTTTGTTGTTAGTAACAAAAA
TCATTCTCAATCGAAACATGGACTTCAATATGAAGCAATGGAGTAATCAACATGAGTCAGAAAATC
AAGAATCACCAACAAAGTTACCAAGACTTCTTCTTGACTTCCACTCTGTTTCTTCTGATTCTGCTT
CTGCTGCTGCTCTACCATTGTTTGTATCTGAACCAACAACATCAACAACAACTTGTACCAAATTAA
TGTCAGATTCAGCAACCACTGTCACCACCAAATTTCCAAGGATTGGAAGTGGTGGTGGTTACTTCA
GCTTGGCTCAATGGCAAGAACTTGAACTACACAGTTTGATTTTAGGCATTTTGTAGCTGGTGCCC
CTGTTCCTTCTGAACTACTTCATCTTGTTAAGAAAGTATTATTGCTTCTCCTCCTCCTCCTCCTT
CATATTACTTTGCTCATCCATATCAACAGTATCCTCATTATCAACAAGCTTTGATGCAGTCAGGGT
ACTGGGGTAGAGCCGCCATGGATCCAGAACCAGGAAGGTGTAGGAGGACTGATGGCAAGAAATGGA
GGTGCTCAAGGGATGTAGTGGCTGGCCAGAAATACTGCGAGCGCCACGTTCATCGTGGCCGCAGCC
GTTCAAGAAAGCCTGTGGAAATTCCCACACCTGCCAACAATGGCAGTAAAAACAACAACACTGTTT
CTCATCATCAAGCCTTTGGAAAAATGACTGGACATGCTCATGCTGGTGGTGGTGCTCCTCAGTTTT
CTCTTTCGGGACATTCACCTTCCACTAATGCGCCTTTTCATCTCAATCAAAGGCCAATTAAGGGTC
CACCACAAGAAGTACTTCAAAAAGATGTATCTATTGGTGATGGTAAATCATCTAGTGGCCAAATCC
TACGCCATTTCTTCGACGATTGGCCTAGACAACAACTTCAAGAAGGCGACAATGCTGCAACCAGCC FIGURE 5 (continued)

```
TGTCCATTTCGATGCCCGGTGTAGGGGGTAACCCCTCGTCAGACTTCTCGTTGAAGCTTTCAACTG
GGAATTACTATGATTCAGGTACTCAAGTTAGTAATGTTGAACGGTCTACATGGGGACGAGTCACC
ACCACGTAGCCTCAATGGGTGGTCCACTTGCCGAGGCCTTAAGGTCATCAACAACTAACTCGTCCC
CTACTAGCGTGTTGCATCAATTGGCACGAGGTAGCGCGTCCGAGGCCAGCTATATTAGCACTTGAT
TTCTGCAAGTGTTCTTGTTAAATGTTTTTTCTTTTGGACTTTATTGTTTTTTAACTTGGTTGTGT
TGTTGTTCATTGTTCTTTATTGGTATTGATATACCTAACTGTCACCTGTACAAAAAAAAAAAAAA
AAA
```

SEQ ID NO: 26, Lycopersicon esculentum Lyces_GRF translated polypeptide sequence
```
MDFNMKQWSNQHESENQESPTKLPRLLLDFHSVSSDSASAAALPLFVSEPTTSTTTCTKLMSDSAT
TVTTKFPRIGSGGGYFSLAQWQELELHSLIFRHFVAGAPVPSELLHLVKKSIIASPPPPPSYYFAH
PYQQYPHYQQALMQSGYWGRAAMDPEPGRCRRTDGKKWRCSRDVVAGQKYCERHVHRGRSRSRKPV
EIPTPANNGSKNNNTVSHHQAFGKMTGHAHAGGGAPQFSLSGHSPSTNAPFHLNQRPIKGPPQEVL
QKDVSIGDGKSSSGQILRHFFDDWPRQQLQEGDNAATSLSISMPGVGGNPSSDFSLKLSTGNYYDS
GTQVSNVERSTWGTSHHHVASMGGPLAEALRSSTTNSSPTSVLHQLARGSASEASYIST
```

SEQ ID NO: 27, Medicago truncatula Medtr_GRF nucleic acid sequence AC144645.17
```
ATGATGAGTGCAAGTTCAAGAAATAGGTCACTTTTCACACCAAATCAATGGCAAGAACTTGAACAA
CAAGCCCTAGTTTTTAAATACATGGTTACTGGAACACCTATTCCACCAGATCTCATATACTCTATT
AAGAGAAGTTTAGACACTTCAATATCTTCAAGAATCTTTCCTCATCCACCAATTGGGTGGGGATGT
TTTGAAATGGGATTTGGCAGAAAAGTAGACCCAGAGCCAGGGAGGTGCAGAAGAACAGATGGCAAG
AAATGGAGATGCTCAAAGGAAGCATATCCAGACTCAAAGTACTGTGAAAGACACATGCACAGAGGT
AGAAACCGTTCAAGAAAGCCTGTGGAACTAGTAGTTTCTTCTTCAACAACAACACCAACAAATAAC
ACAAACACAGCATCTTCTTACAGCAACAGAAACATCTCCTTGAACAACAACAGCAGCAGCATAAAC
TCACCTTCTTCTTTCCCTTTCTCTACTTCATCCATGGCTTGTCATGATCAGTCACAATCTTTTTCA
CAATCCTACCAAAACTCTTCTTTAAACCCTTACTATTACTCTCAATCAATTACCTCTACTAACCCA
CTTGATCATTCTCATTTTCAAACTCAAGATGCTACTACTCATCACCTCTTTTTGGACTCAACATCT
TATTCTCAGGATGACAAGGACTTTAGGTATGTACAAGTTCAAGGAATAAGAGATGGTACTGTGGAT
GAGAGAACTTTCTTTCCAGAAGCTACAGGTTCATCTAGGAGCTGTTATCATGATTCATATCAACAA
CAACTATCAATGAATCCCTTTAAGTCTTACTCAAGCTCACAGTTTCAGAATATCAATGATGATAAT
TCAAGACAACAACAAGAACAACACTGTTTTGTTTTAGGCACTGACATCAAGTCAACAAGAACAACA
AACAAGGACAAAGAAAGTGAGACAACTCAGAAACCACTTCATCATTTCTTTGGTGAGTGGACACCA
AAGAACACAGATTCCTGGCTAGATCTTGCTTCTAACTCCAGAATTCCAACAGGTTGATTATCATTT
ATCATCATTCCTATGTTTTTGTTTTTTTTTTGTTATTATTAATA
```

SEQ ID NO: 28, Medicago truncatula Medtr_GRF translated polypeptide sequence
```
MMSASSRNRSLFTPNQWQELEQQALVFKYMVTGTPIPPDLIYSIKRSLDTSISSRIFPHPPIGWGC
FEMGFGRKVDPEPGRCRRTDGKKWRCSKEAYPDSKYCERHMHRGRNRSRKPVELVVSSSTTTPTNN
TNTASSYSNRNISLNNNSSSINSPSSFPFSTSSMACHDQSQSFSQSYQNSSLNPYYYSQSITSTNP
LDHSHFQTQDATTHHLFLDSTSYSQDDKDFRYVQVQGIRDGTVDERTFFPEATGSSRSCYHDSYQQ
QLSMNPFKSYSSSQFQNINDDNSRQQQEQHCFVLGTDIKSTRTTNKDKESETTQKPLHHFFGEWTP
KNTDSWLDLASNSRIPTG
```

FIGURE 5 (continued)

SEQ ID NO: 29, Medicago truncatula Medtr_GRF_like nucleic acid sequence AC174350.4
ATGCATATGTTGACAATGGAAGCTAAACCTCTTCAACTTGTTCCCTCTTCACACAACAGCACAACT
GGTGGTGGACCCCAGATGAAGATTGAGAATGGTGAAGTTGATGAAGAGAAAAGGGTTGTTGTTGGA
GTGAAGGAAGATATAGAAAACAAGCCTTTGATCACAGAAGCTCAAAGGCGTGAACTTGATCATCAA
GTTTTTATTTTTAATCATTTTGCTTATAATCTTCCTCTTCCTTATTACCTTTTGCAATTTCCAAGT
AATATGTCAGAGTACAGTCGTCGTGGTCTGATTATGTGACTATGGTGGATCAAGAACCACATAGG
TGTAGAAGAACTGACGGAAAGAAATGGAGGTGCGGCAAGGACACAGTACCTAATCAGAAGTATTGT
GAACGTCACATGCACAGAGGTCGAAATCGTTCAAGAAAGCTTGTGGAAACATCTCAACTTAACTCT
CCTTTGAAAACAAATCCTAGTGGTGGTGGCAAGTCACATGCAAAACTAGTCCCAAACATTAAATCT
TCAGTTTCAAATCCAAACCCTTTGATTATTCATCACAATGGCACATTCTCATACAATCCGAGGACC
TTCTGCGTTGTAGATACTTCTTCTGTTTGTGATCGGTCGAGACATGTCATAGATTATGGTGCCACT
GCAGTGACAACTTCGGGAAGCACGACATCCGTTTCTTTGGATAACAGAGTTTGTCCTAACGTATGC
AAGCAAGATGAGCAGATCAAGAGGTGTATCACCGACAACGTGGGTATTAAAAGTGGTCGGAAAGGA
AGCATATCTTGTGAAAGTATTGGCATCTCTACTGGAATAGGCTTTTCCCCAAAGAGTGTTCTTCCA
GTTTCTGGTTGCAATGATTCATACCTCAACAACAGAAACAATATATTAGAACCTGAACCCGGTAGA
TGCCGAAGAACAGATGGTAAGAAGTGGCGATGCAAGAGTGCGGTTCTTCCAGGTCAGAAGTATTGT
GCAACACATATGCATAGAGGTGCTAAAAGGCGTTTTACAAACCTCGAATCTCCTCCTCCTGCCACC
ACTGTTATTCCTAAAACTACTGATATTAGTTCAGCTGTTACCATTGCTCAGTTGCCCGACCCTTCG
GCTCCAATCGACATCCAGAAAGCGAATTGTTGGTCTCCGAGCACTAAGCTTTCAATGTCGGTTCAA
GAAAGTGCGCCCTTTGTTGATTGTAATGAGAAAAGTGTTAGCAGCGGTGACACGGATGGTACTAGT
ACCACCATCACTGACACCATGAATGAGTGTAGCTATCTTTCTTTCTAA

SEQ ID NO: 30, Medicago truncatula Medtr_GRF_like translated polypeptide sequence
MHMLTMEAKPLQLVPSSHNSTTGGGPQMKIENGEVDEEKRVVVGVKEDIENKPLITEAQRRELDHQ
VFIFNHFAYNLPLPYYLLQFPSNMSEYSRRGSDYVTMVDQEPHRCRRTDGKKWRCGKDTVPNQKYC
ERHMHRGRNRSRKLVETSQLNSPLKTNPSGGGKSHAKLVPNIKSSVSNPNPLIIHHNGTFSYNPRT
FCVVDTSSVCDRSRHVIDYGATAVTTSGSTTSVSLDNRVCPNVCKQDEQIKRCITDNVGIKSGRKG
SISCESIGISTGIGFSPKSVLPVSGCNDSYLNNRNNILEPEPGRCRRTDGKKWRCKSAVLPGQKYC
ATHMHRGAKRRFTNLESPPPATTVIPKTTDISSAVTIAQLPDPSAPIDIQKANCWSPSTKLSMSVQ
ESAPFVDCNEKSVSSGDTDGTSTTITDTMNECSYLSF

SEQ ID NO: 31, Oryza sativa Orysa_GRF_Os02g47280 nucleic acid sequence
ATGGCGATGCCGTATGCCTCCCTGTCTCCGGCGGTGGCCGACCACCGCTCGTCCCCGGCAGCCGCG
ACCGCCTCCCTCCTCCCCTTCTGCCGCTCCACCCCGCTCTCCGCGGGCGGTGGTGGCGTCGCGATG
GGGGAGGACGCGCCGATGACCGCGAGGTGGCCGCCGGCGGCGGCGGCGAGGCTGCCGCCGTTCACC
GCGGCGCAGTACGAGGAGCTGGAGCAGCAGGCGCTCATATACAAGTACCTGGTGGCAGGCGTGCCC
GTCCCGCCGGATCTCGTGCTCCCCATCCGCCGCGGACTCGACTCCCTCGCCGCCCGCTTCTACAAC
CATCCCGCCCTTGGATATGGTCCGTACTTCGGCAAGAAGCTGGACCCAGAGCCAGGGCGGTGCCGG
CGTACGGACGGCAAGAAATGGCGGTGCTCGAAGGAGGCCGCGCCGGATTCCAAGTACTGCGAGCGC
CACATGCACCGCGGCCGCAACCGTTCAAGAAAGCCTGTGGAAACGCAGCTGGTCGCCCAGTCCCAA
CCGCCCTCATCTGTTGTCGGTTCTGCGGCGGCGCCCCTTGCTGCTGCCTCCAATGGCAGCAGCTTC
CAAAACCACTCTCTTTACCTGCTATTGCCGGCAGCAATGGCGGGGCGGGGGAGGAACATGCCC
AGCTCATTTGGCTCGGCGTTGGGTTCTCAGCTGCACATGGATAATGCTGCCCCTTATGCAGCTGTT
GGTGGTGGAACAGGCAAAGATCTCAGGTATACTGCTTATGGCACAAGATCTTTGGCGGATGAGCAG
AGTCAACTCATTACTGAAGCTATCAACACATCTATTGAAAATCCATGGCGGCTGCTGCCATCTCAG FIGURE 5 (continued)

```
AACTCGCCATTTCCCCTTTCAAGCTATTCTCAGCTGGGGGCACTAAGTGACCTTGGTCAGAACACC
CCCAGCTCACTTTCAAAGGTTCAGAGGCAGCCACTTTCGTTCTTTGGGAACGACTATGCGGCTGTC
GATTCTGTGAAGCAAGAGAACCAGACGCTGCGTCCCTTCTTTGATGAGTGGCCAAAGGGAAGGGAT
TCATGGTCAGACCTCGCTGATGAGAATGCTAATCTTTCGTCATTCTCAGGCACCCAACTGTCGATC
TCCATACCAATGGCATCCTCTGACTTCTCGGCGGCCAGTTCTCGATCAACTAATGGTGACTGA
```

SEQ ID NO: 32, Oryza sativa Orysa_GRF_ Os02g47280.2 translated polypeptide sequence
```
MAMPYASLSPAVADHRSSPAAATASLLPFCRSTPLSAGGGGVAMGEDAPMTARWPPAAAARLPPFT
AAQYEELEQQALIYKYLVAGVPVPPDLVLPIRRGLDSLAARFYNHPALGYGPYFGKKLDPEPGRCR
RTDGKKWRCSKEAAPDSKYCERHMHRGRNRSRKPVETQLVAQSQPPSSVVGSAAAPLAAASNGSSF
QNHSLYPAIAGSNGGGGGRNMPSSFGSALGSQLHMDNAAPYAAVGGGTGKDLRYTAYGTRSLADEQ
SQLITEAINTSIENPWRLLPSQNSPFPLSSYSQLGALSDLGQNTPSSLSKVQRQPLSFFGNDYAAV
DSVKQENQTLRPFFDEWPKGRDSWSDLADENANLSSFSGTQLSISIPMASSDFSAASSRSTNGD
```

SEQ ID NO: 33, Oryza sativa Orysa_GRF_Os02g53690 nucleic acid sequence
```
ATGATGATGATGAGCGGTCGCCCGAGCGGCGGCGCCGGCGGAGGTCGGTACCCGTTCACGGCGTCG
CAGTGGCAGGAGCTGGAGCACCAGGCGCTCATCTACAAGTACATGGCGTCCGGGACTCCCATCCCC
TCCGACCTCATCCTCCCCCTCCGCCGCAGCTTCCTCCTCGACTCCGCCCTCGCCACCTCCCCTTCC
CTCGCCTTCCCTCCCCAACCTTCACTGGGGTGGGGTTGCTTTGGCATGGGGTTTGGGCGGAAGGCG
GAGGACCCGGAGCCAGGGCGATGCCGGCGTACGGACGGCAAGAAGTGGCGGTGCTCCAAGGAGGCG
TACCCGGACTCCAAGTACTGCGAGAAGCACATGCACCGTGGCAAGAACCGTTCAAGAAAGCCTGTG
GAAATGTCCTTGGCCACGCCGCCGCCGCCGTCCTCCTCCGCCACCTCCGCCGCGTCGAACACCTCC
GCCGGCGTCGCCCCCACCACCACCACCACCTCCTCCCCGGCGCCCTCCTACAGCCGCCCGGCGCCG
CACGACGCGGCGCCGTACCAGGCGCTCTACGGCGGGCCCTACGCCGCGGCCACCGCGCGCACCCCC
GCCGCCGCGGCGTACCACGCGCAGGTGAGCCCGTTCCACCTCCAGCTCGACACCACCCACCCGCAC
CCGCCGCCGTCCTACTACTCCATGGACCACAAGGAGTACGCGTACGGGCACGCCACCAAGGAGGTG
CACGGCGAGCACGCCTTCTTCTCCGATGGCACCGAGAGGGAGCACCACCACGCCGCCGCCGGGCAC
GGCCAGTGGCAGTTCAAGCAGCTCGGCATGGAGCCCAAGCAGAGCACCACGCCTCTCTTCCCGGGC
GCCGGCTACGGCCACACCGCGGCGTCGCCGTACGCCATTGATCTTTCAAAAGAGGACGACGATGAG
AAAGAGAGGCGGCAACAGCAGCAGCAGCAGCAGCAGCAGCACTGCTTCCTCCTGGGCGCCGACCTC
CGTCTGGAGAAGCCGGCGGGCCACGACCACGCGGCGGCGGCGCAGAAACCTCTCCGCCACTTCTTC
GACGAGTGGCCGCATGAGAAGAACAGCAAGGGCTCCTGGATGGGGCTCGAAGGCGAGACGCAGCTG
TCCATGTCCATCCCCATGGCCGCCAACGACCTCCCGATCACCACCACCTCCCGCTACCACAATGAT
GATTAA
```

SEQ ID NO: 34, Oryza sativa Orysa_GRF_Os02g53690 translated polypeptide sequence
```
MMMMSGRPSGGAGGGRYPFTASQWQELEHQALIYKYMASGTPIPSDLILPLRRSFLLDSALATSPS
LAFPPQPSLGWGCFGMGFGRKAEDPEPGRCRRTDGKKWRCSKEAYPDSKYCEKHMHRGKNRSRKPV
EMSLATPPPPSSSATSAASNTSAGVAPTTTTTSSPAPSYSRPAPHDAAPYQALYGGPYAAATARTP
AAAAYHAQVSPFHLQLDTTHPHPPPSYYSMDHKEYAYGHATKEVHGEHAFFSDGTEREHHHAAAGH
GQWQFKQLGMEPKQSTTPLFPGAGYGHTAASPYAIDLSKEDDDEKERRQQQQQQQQHCFLLGADL
RLEKPAGHDHAAAAQKPLRHFFDEWPHEKNSKGSWMGLEGETQLSMSIPMAANDLPITTTSRYHND
D
```

SEQ ID NO: 35, Oryza sativa Orysa_GRF_Os03g51970.1 nucleic acid sequence
ATGCAGGGTGCAATGGCCAGGGTGAGGGGTCCCTTCACGCCGTCTCAGTGGATCGAGCTGGAGCAC
CAGGCGCTGATATACAAGTACTTGGCTGCGAATAGCCCTGTACCACACAGCCTCCTCATCCCCATC
AGGAGGAGCCTCACATCGCCCTACTCACCTGCCTACTTTGGCTCAAGCACATTGGGATGGGGATCT
TTCCAGCTGGGCTACTCCGGCAGCGCGGATCCGGAGCCCGGCCGGTGCCGCCGGACGGACGGCAAG
AAATGGCGGTGCTCGAGGGATGCGGTCGCCGACCAGAAGTACTGTGAGCGACACATGAACCGGGGA
CGCCACCGTTCAAGAAAGCATGTGGAAGGCCAGCCTGGCCATGCCGCGAAAGCGATGCCCGCGGCG
GTGGCAGCAGCCGCTGCCTCTGCTACCCAGCCTAGTGCTCCGGCCGCCCACAGTGGCGGAGCTGTT
GCTGGCCTCGCTATCAACCATCAGCACCAGCAAATGAAGAACTACGCTGCCAACACTGCCAATCCT
TGCTCTCTGCAATATAGCAGGGATCTGGCAAACAAGCATAATGAGAGTGAACAAGTGCAAGACTCA
GACAGTCTCTCGATGCTGACTTCCATTAGCACGAGAAATACGGGCAGCCTGTTTCCGTTCTCAAAA
CAACATAATCCTTTTGAAGTGTCCAACTCAAGGCCAGATTTTGGCCTAGTATCACCTGATTCACTG
ATGAGTTCTCCTCATAGCTCCTTGGAGAACGTCAATTTGCTCACTTCGCAGAGTCTGAATGAACAA
CAGAGTTCAGTTTCCCTTCAACACTTTGTGGACTGGCCAAGGACACCTGCACAAGGAGCTCTCGCA
TGGCCTGATGCTGAAGACATGCAAGCTCAGAGAAGCCAGCTCTCAATATCTGCTCCAATGGCGTCT
TCTGACCTGTCATCAGCCTCAACATCTCCCATCCATGAGAAGCTGATGTTGTCACCACTTAAACTG
AGCCGTGAATATAGTCCTATTGGTCTCGGTTTTGCAGCAAATAGAGATGAGGTTAACCAGGGAGAA
GCAAACTGGATGCCTATGTTCCGTGATTCTTTGATGGGCGGACCATTGGGAGAGGTTTTAACCAAG
AATAACAACATGGAAGCAAGGAATTGCCTATCGGAGTCTCTGAATCTTTTAAATGATGGCTGGGAT
TCAAGCTCAGGGTTTGATTCATCCCCAGTTGGTGTTCTGCAGAAGACCACCTTTGGATCAGTATCC
AGTAGCACCGGAAGCAGTCCTAGACTGGAGAATCATAGTGTTTATGATGGCAACAGTAACCTGCGG
GATGATCTCGGTTCAGTTGTTGTAAATCATCCGAGCATCCGCCTGGTGTGA

SEQ ID NO: 36, Oryza sativa Orysa_GRF_Os03g51970.1 translated polypeptide sequence
MQGAMARVRGPFTPSQWIELEHQALIYKYLAANSPVPHSLLIPIRRSLTSPYSPAYFGSSTLGWGS
FQLGYSGSADPEPGRCRRTDGKKWRCSRDAVADQKYCERHMNRGRHRSRKHVEGQPGHAAKAMPAA
VAAAAASATQPSAPAAHSGGAVAGLAINHQHQQMKNYAANTANPCSLQYSRDLANKHNESEQVQDS
DSLSMLTSISTRNTGSLFPFSKQHNPFEVSNSRPDFGLVSPDSLMSSPHSSLENVNLLTSQSLNEQ
QSSVSLQHFVDWPRTPAQGALAWPDAEDMQAQRSQLSISAPMASSDLSSASTSPIHEKLMLSPLKL
SREYSPIGLGFAANRDEVNQGEANWMPMFRDSLMGGPLGEVLTKNNNMEARNCLSESLNLLNDGWD
SSSGFDSSPVGVLQKTTFGSVSSSTGSSPRLENHSVYDGNSNLRDDLGSVVVNHPSIRLV

SEQ ID NO: 37, Oryza sativa Orysa_GRF_Os04g48510.1 nucleic acid sequence
ATGTTGGCCGAGGGAAGGCAAGTCTACTTGCCGCCGCCGCCGCCGTCCAAGCTTCCTCGTCTCTCC
GGCACCGATCCAACCGACGGCGTGGTGACGATGGCAGCGCCGTCGCCGCTGGTTCTTGGGCTGGGT
CTCGGTCTGGGCGGCAGCGGCAGCGACAGCAGTGGGAGCGACGCGGAAGCGTCTGCGGCCACCGTG
CGGGAGGCGCGGCCGCCGTCGGCGCTGACGTTCATGCAGCGGCAGGAGCTGGAGCAGCAGGTGCTC
ATCTACCGCTACTTCGCCGCCGGCGCGCCTGTGCCGGTTCACCTCGTGCTGCCCATATGGAAGAGC
ATCGCCGCCGCCTCCTCGTTCGGCCCGCAAAGCTTTCCCTCCCTGACGGGCCTGGGGAGCCTGTGC
TTCGACTACAGGAGCAGCATGGAGCCGGAGCCGGGGCGGTGCCGGCGCACGGACGGCAAGAAGTGG
CGGTGCTCGCGCGACGTGGTGCCGGGGCACAAGTATTGCGAGCGGCACGTCACCGTGGCCGCGGCC
CGTTCAAGAAAGCCTATGGAAGCCTCTGCAGCAGTCGCTCCCACATATCTCCCGGTCCGGCCGGCA
CTCCACACCGTCGCCACCCTCGCCACCAGCGCGCCATCGCTGTCGCACCTCGGTTTCTCCTCCGCC
AGCAAAGTGCTCCTCGCCCACACCACCACCGGCACCACGCGCGCTACTTGA

SEQ ID NO: 38, Oryza sativa Orysa_GRF_Os04g48510.1 translated polypeptide sequence
MLAEGRQVYLPPPPPSKLPRLSGTDPTDGVVTMAAPSPLVLGLGLGLGGSGSDSSGSDAEASAATV
REARPPSALTFMQRQELEQQVLIYRYFAAGAPVPVHLVLPIWKSIAAASSFGPQSFPSLTGLGSLC
FDYRSSMEPEPGRCRRTDGKKWRCSRDVVPGHKYCERHVHRGRGRSRKPMEASAAVAPTYLPVRPA
LHTVATLATSAPSLSHLGFSSASKVLLAHTTTGTTRAT

SEQ ID NO: 39, Oryza sativa Orysa_GRF_Os04g51190.1 nucleic acid sequence
ATGGCGATGCCCTTTGCCTCCCTGTCGCCGGCAGCCGACCACCGGCCCTCCTTCATCTTCCCCTTC
TGCCGCTCCTCCCCTCTCTCCGCGGTCGGGGAGGAGGCGCAGCAGCACATGATGGGCGCGAGGTGG
GCGGCGGCGGTGGCCAGGCCGCCGCCCTTCACGGCGGCGCAGTACGAGGAGCTGGAGCAGCAGGCG
CTCATATACAAGTACCTCGTCGCCGGCGTGCCCGTCCCGGCGGATCTCCTCCTCCCCATCCGCCGT
GGCCTCGACTCACTCGCCTCGCGCTTCTACCACCACCCTGTCCTTGGATACGGTTCCTACTTCGGC
AAGAAGCTGGACCCGGAGCCCGGACGGTGCCGGCGTACGGACGGCAAGAAGTGGCGGTGCTCCAAG
GAGGCCGCGCCGGACTCCAAGTACTGTGAGCGACACATGCACCGCGGCCGCAACCGTTCAAGAAAG
CCTGTGGAAGCGCAGCTCGTCGCCCCCACTCGCAGCCCCCGCCACGGCGCCGGCCGCCGCCGTC
ACCTCCACCGCCTTCCAGAACCACTCGCTGTACCCGGCGATTGCTAATGGCGGCGGCGCCAACGGA
GGCGGTGGTGGTGGTGGCGGTGGCGGCAGCGCGCCTGGCTCGTTCGCCTTGGGGTCTAATACTCAG
CTGCACATGGACAATGCTGCGTCTTACTCGACTGTTGCTGCTGGTGCCGGAAACAAAGATTTCAGG
TATTCTGCTTATGGAGTGAGACCATTGGCAGATGAGCACAGCCCACTCATCACTGGAGCTATGGAT
ACCTCTATTGACAATTCGTGGTGCTTGCTGCCTTCTCAGACCTCCACATTTTCAGTTTCGAGCTAC
CCTATGCTTGGAAATCTGAGTGAGCTGGACCAGAACACCATCTGCTCGCTGCCGAAGGTGGAGAGG
GAGCCATTGTCATTCTTCGGGAGCGACTATGTGACCGTCGACTCCGGGAAGCAGGAGAACCAGACG
CTGCGCCCCTTTTTCGACGAGTGGCCAAAGGCAAGGGACTCCTGGCCTGATCTAGCTGATGACAAC
AGCCTTGCCACCTTCTCTGCCACTCAGCTCTCGATCTCCATTCCAATGGCAACCTCTGACTTCTCG
ACCACCAGCTCACGATCACACAACGGTATATACTCCCGATGA

SEQ ID NO: 40, Oryza sativa Orysa_GRF_Os04g51190.1 translated polypeptide sequence
MAMPFASLSPAADHRPSFIFPFCRSSPLSAVGEEAQQHMMGARWAAAVARPPPFTAAQYEELEQQA
LIYKYLVAGVPVPADLLLPIRRGLDSLASRFYHHPVLGYGSYFGKKLDPEPGRCRRTDGKKWRCSK
EAAPDSKYCERHMHRGRNRSRKPVEAQLVAPHSQPPATAPAAAVTSTAFQNHSLYPAIANGGGANG
GGGGGGGGSAPGSFALGSNTQLHMDNAASYSTVAAGAGNKDFRYSAYGVRPLADEHSPLITGAMD
TSIDNSWCLLPSQTSTFSVSSYPMLGNLSELDQNTICSLPKVEREPLSFFGSDYVTVDSGKQENQT
LRPFFDEWPKARDSWPDLADDNSLATFSATQLSISIPMATSDFSTTSSRSHNGIYSR

SEQ ID NO: 41, Oryza sativa Orysa_GRF_LOC_Os06g02560.1 nucleic acid sequence
ATGCTGAGCTCGTCGCCCTCGGCGGCGGCGCCGGGGATAGGAGGGTACCAGCCGCAGCGCGGGCG
GCGGTCTTCACGGCGGCGCAGTGGGCGGAGCTGGAGCAGCAGGCGCTCATTTACAAGTACCTCGTC
GCCGGTGTCCCCGTCCCGGGCGATCTCCTCCTCCCAATCCGCCCCACTCCTCCGCCGCCGCCACC
TACTCCTTCGCCAACCCCGCCGCCGCGCCCTTCTACCACCACCACCACCACCCCTCTCTGAGCTAT
TATGCCTACTATGGCAAGAAGCTTGACCCTGAGCCGTGGCGTTGCCGCCGCACCGACGGCAAGAAG
TGGCGGTGCTCCAAGGAGGCGCACCCCGACTCCAAGTACTGCGAGCGCCACATGCACCGTGGCCGC
AACCGTTCAAGAAAGCCTGTGGAATCCAAGACCGCTGCCCCTGCGCCCCAGTCGCAGCCCCAGCTG
TCCAATGTCACGACCGCGACTCACGACACCGATGCGCCTCTCCCGTCACTCACTGTGGGTGCTAAA
ACCCACGGTCTGTCCCTTGGTGGTGCTGGCTCGTCGCAGTTCCATGTCGACGCACCATCGTACGGC FIGURE 5 (continued)

```
AGCAAGTACTCTCTTGGAGCTAAAGCTGATGTGGGTGAACTGAGCTTCTTCTCAGGAGCATCAGGA
AACACCAGGGGCTTCACCATTGATTCTCCAACAGATAGCTCATGGCATTCACTGCCTTCCAGTGTA
CCCCCATACCCGATGTCAAAGCCAAGGGACTCTGGCCTCCTACCAGGTGCCTACTCCTACTCCCAC
CTTGAACCTTCACAGGAACTTGGCCAGGTCACCATCGCCTCGCTGTCCCAAGAGCAGGAGCGCCGC
TCTTTTGGTGGTGGAGCGGGGGGGATGCTAGGAAATGTGAAGCACGAGAACCAGCCGCTGAGGCCT
TTCTTCGATGAGTGGCCTGGGAGGCGAGACTCGTGGTCGGAGATGGATGAGGAGAGGTCCAACCAG
ACCTCCTTCTCGACAACCCAGCTCTCGATCTCCATCCCGATGCCCAGATGTGGGTCCCCTATCGGT
CCGCGTCTACCTTGA
```

SEQ ID NO: 42, Oryza sativa Orysa_GRF_LOC_Os06g02560.1 translated polypeptide sequence
```
MLSSSPSAAAPGIGGYQPQRGAAVFTAAQWAELEQQALIYKYLVAGVPVPGDLLLPIRPHSSAAAT
YSFANPAAAPFYHHHHHPSLSYYAYYGKKLDPEPWRCRRTDGKKWRCSKEAHPDSKYCERHMHRGR
NRSRKPVESKTAAPAPQSQPQLSNVTTATHDTDAPLPSLTVGAKTHGLSLGGAGSSQFHVDAPSYG
SKYSLGAKADVGELSFFSGASGNTRGFTIDSPTDSSWHSLPSSVPPYPMSKPRDSGLLPGAYSYSH
LEPSQELGQVTIASLSQEQERRSFGGGAGGMLGNVKHENQPLRPFFDEWPGRRDSWSEMDEERSNQ
TSFSTTQLSISIPMPRCGSPIGPRLP
```

SEQ ID NO: 43, Oryza sativa Orysa_GRF_Os11g35030.1 nucleic acid sequence
```
ATGCTGAGCTCTTGTGGTGGCCATGGCCATGGAAATCCAAGAAGCTTGCAAGAAGAACACCATGGC
AGATGTGGTGAGCAGCAAGGTGGAGGAGGAGGAGGAGGGCAAGAGCAAGAGCAAGATGGGTTCTTG
GTGAGAGAGGCAAGGGCATCCCCACCATCTCCATCTTCTTCATCATTTCTTGGATCCACAAGCTCT
TCTTGTTCTGGAGGAGGAGGAGGAGGGCAGATGTTGAGCTTCTCCTCCCCCAATGGAACAGCAGGG
TTGGGCTTGAGCTCAGGAGGAAGCATGCAGGGGGTCTTGGCAAGGGTCAGGGGGCCGTTCACCCCA
ACACAGTGGATGGAGCTGGAGCACCAGGCACTGATCTACAAGCACATTGCTGCAAATGTTTCTGTC
CCTTCCAGCTTGCTCCTCCCCATCAGGAGAAGCCTCCATCCATGGGGATGGGGATCATTCCCTCCT
GGCTGTGCTGATGTAGAACCCAGAAGATGCCGCCGCACAGACGGCAAGAAGTGGCGGTGCTCCAGA
GATGCTGTTGGGGATCAGAAGTATTGTGAGCGACACATAAACCGTGGTCGCCATCGTTCAAGAAAG
CATGTGGAAGGCCGAAAGGCGACACTCACCATTGCAGAACCATCCACGGTTATTGCTGCTGGTGTA
TCATCTCGCGGCCACACTGTGGCTCGGCAGAAGCAGGTGAAAGGCTCAGCTGCTACTGTCTCTGAT
CCTTTCTCGAGACAATCCAACAGGAAATTTCTGGAGAAACAGAACGTTGTCGACCAATTGTCTCCC
ATGGATTCATTTGATTTCTCATCCACACAATCTTCTCCAAACTATGACAATGTAGCATTGTCACCA
CTGAAGTTGCACCATGATCATGATGAATCTTACATCGGGCATGGAGCAGGCAGTTCATCAGAAAAA
GGCAGTATGATGTACGAAAGTCGGTTAACAGTCTCTAAGGAAACACTTGATGATGGACCTTTAGGT
GAAGTTTTCAAAAGAAAGAATTGCCAATCAGCTTCTACAGAAATCTTAACTGAAAAATGGACTGAG
AACCCCAACTTACATTGCCCATCTGGAATCCTACAAATGGCTACTAAGTTCAATTCAATTTCCAGC
GGCAACACAGTAAATAGTGGTGGCACCGCAGTGGAGAATCTTATCACTGATAATGGATATCTTACT
GCAAGAATGATGAATCCTCATATTGTCCCAACACTTCTCTAA
```

SEQ ID NO: 44, Oryza sativa Orysa_GRF_Os11g35030.1 translated polypeptide sequence
```
MLSSCGGHGHGNPRSLQEEHHGRCGEQQGGGGGGQEQEQDGFLVREARASPPSPSSSSFLGSTSS
SCSGGGGGGQMLSFSSPNGTAGLGLSSGGSMQGVLARVRGPFTPTQWMELEHQALIYKHIAANVSV
PSSLLLPIRRSLHPWGWGSFPPGCADVEPRRCRRTDGKKWRCSRDAVGDQKYCERHINRGRHRSRK
HVEGRKATLTIAEPSTVIAAGVSSRGHTVARQKQVKGSAATVSDPFSRQSNRKFLEKQNVVDQLSP
MDSFDFSSTQSSPNYDNVALSPLKLHHDHDESYIGHGAGSSSEKGSMMYESRLTVSKETLDDGPLG
EVFKRKNCQSASTEILTEKWTENPNLHCPSGILQMATKFNSISSGNTVNSGGTAVENLITDNGYLT
ARMMNPHIVPTLL
```

FIGURE 5 (continued)

SEQ ID NO: 45, Oryza sativa Orysa_GRF_LOC_Os12g29980.1 nucleic acid sequence
ATGGCAATGGCGACCCCTACGACCAACGGCAGCTTCCTTCTTGGATCAGGTGGCTATCCCGGTGCC
CAGATTCTAAGCTTCTCCTCCTCAGGTCACAGCGGCAATGGGTTGGATTGTGGAAGCTCAGATGTG
GCAAGAATGCAGGGGGTTTTAGCAAGGGTTAGGGGGCCATTCACACCAACACAATGGATGGAGCTG
GAGCACCAGGCTCTGATCTACAAGCACATTGTGGCGAATGCGCCGGTACCGGCCGGCTTGCTCCTC
CCCATCAGGAGAAGCCTCCATCCACCAGTGTTCCCACACTTCTCCTCTGGTGGCATTCTTGGCTCC
AGCTCCTTGGGATGGGGGTCATTTCAGCTGGGCTATTCTGGGAGTGCTGACTCCGAGCCCGGGAGA
TGCCGTCGAACCGATGGCAAGAAATGGCGGTGCTCGAGAGACGCAGTTGTCGACCAAAAGTACTGC
GAGCGGCACATAAACCGGGGTCGCCACCGTTCAGAAAGCATGTGGAAGGCCAATCTAGCCATGCC
GCAAAAGCAACGGTTCCCGCCATAGCACAACCACCCATTGGTGCATCTAATGGCAAATTGTCAGGC
AGCCATGGTGTGTCAAATGAGCTCACGAAAACCTTGGCTACTAACAGGATGATGTTGGATAAAGCA
AATCTTATTGAACGCTCCCAGGACTACACTAATCAGCAACACAACATCCTACAGAACAACACAAAA
GGTGATAATTGGTCTGAAGAGATGTCCTCACAAGCAGACTATGCAGTAATCCCTGCTGGCTCTCTC
ATGAACACACCGCAATCGGCGAATTTAAATCCAATTCCCCAGCAACAACGCTGTAAGCAGTCACTC
TTTGGCAAAGGGATACAGCATGATGACATTCAGCTGTCGATATCCATTCCCGTGGATAACTCCGAC
TTACCCACTAACTACAACAAGGCTCAAATGGACCATGTAGTAGGCGGTTCATCGAATGGCGGAAAC
AACACGCGAGCAAGTTGGATACCGGGCTCCTGGGAAGCGTCCATAGGTGGACCTCTGGGTGAGTTC
TTCACCAACACCAGCAGCGCATCAGACGACAAAGGCAAAAGCCGCCACCCGCCATCTTTGAACCTC
TTAGCTGATGGACATACTACAAGTCCACAGCTGCAATCGCCCACCGGAGTCCTGCAGATGACTAGC
TTCAGTTCAGTGCCCAGCAGCACTGTTAGTAGTCCTGCAGGCAGCCTCTGCAATGGCTTGCTCACT
TCAGGCCTGGTGAATGCCCAGACTGTCCAAACACTGTGA

SEQ ID NO: 46, Oryza sativa Orysa_GRF_LOC_Os12g29980.1 translated polypeptide sequence
MAMATPTTNGSFLLGSGGYPGAQILSFSSSGHSGNGLDCGSSDVARMQGVLARVRGPFTPTQWMEL
EHQALIYKHIVANAPVPAGLLLPIRRSLHPPVFPHFSSGGILGSSSLGWGSFQLGYSGSADSEPGR
CRRTDGKKWRCSRDAVVDQKYCERHINRGRHRSRKHVEGQSSHAAKATVPAIAQPPIGASNGKLSG
SHGVSNELTKTLATNRMMLDKANLIERSQDYTNQQHNILQNNTKGDNWSEEMSSQADYAVIPAGSL
MNTPQSANLNPIPQQQRCKQSLFGKGIQHDDIQLSISIPVDNSDLPTNYNKAQMDHVVGGSSNGGN
NTRASWIPGSWEASIGGPLGEFFTNTSSASDDKGKSRHPPSLNLLADGHTTSPQLQSPTGVLQMTS
FSSVPSSTVSSPAGSLCNGLLTSGLVNAQTVQTL

SEQ ID NO: 47, Oryza sativa Orysa_GRF_Os03g47140.1 nucleic acid sequence
ATGTTTGCTGACTTCTCTGCTGCTGCCATGGAGCTTGGAGAGGTGTTGGGCTTGCAAGGACTCACA
GTGCCATCCACCAAGGAGGGTGATCTGAGCCTCATCAAGAGAGCTGCTGCTGGTAGCTTCACCCAG
GCTGCTGCTGCATCATACCCTTCCCCCTTTCTTGATGAACAGAAGATGCTCAGATTCGCCAAGGCT
GCTCACACATTGCCATCAGGTTTGGATTTGGGAGGGAAAATGAGCAGAGGTTCTTGTTGTCTAGG
ACCAAGAGGCCTTTCACTCCCTCACAGTGGATGGAGCTGGAGCACCAGGCTCTCATTTACAAGTAT
CTCAATGCAAAGGCCCCTATACCTTCCAGCCTGCTCATTTCAATCAGCAAAAGCTTCAGATCATCA
GCTAACAGAATGAGCTGGAGGCCTCTCTATCAAGGCTTCCCAAATGCAGACTCTGACCCAGAACCT
GGAAGATGCCGTCGAACAGATGGCAAGAAATGGCGGTGTTCAAAGGAGGCCATGGCCGACCACAAG
TATTGTGAGAGGCACATCAACAGAAACCGCCACCGTTCAGAAAGCCTGTGGAAAACCAAAGTAGA
AAGACTGTGAAAGAGACACCGTGTGCTGGCTCATTGCCATCTTCTGTCGGGCAGGGCAGCTTCAAG
AAGGCAAAAGTTAATGAAATGAAGCCACGCAGTATCAGCTATTGACAGATAGTTTGAACAGGACA
ATGGCGAACAAAGAGAAAGGAAACAAAGCTGCTGAAGAAACAATGGCCCACTGCTAAATTTAACG
AATCAACAGCCAACATTGTCCCTGTTCTCTCAGTTGAAGCAACAGAACAAACCGGAGAAGTTCAAT

```
ACAGCAGGAGACAGTGAATCGATTTCTTCAAATACCATGTTGAAGCCTTGGGAGAGCAGCAACCAG
CAGAACAACAAAAGCATTCCTTTCACCAAGATGCATGATCGTGGATGCCTTCAGTCAGTCCTTCAG
AATTTCAGCTTGCCTAAGGACGAGAAAATGGAGTTTCAGAAAAGCAAAGATTCCAATGTCATGACA
GTTCCATCAACTTTCTATTCCTCGCCAGAGGACCCACGCGTCAGCTGCCATGCACCTAATATGGCA
CAAATGCAAGAGGATAGCATCTCAAGTTCTTGGGAGATGCCTCAAGGTGGACCTCTAGGTGAGATC
TTGACAAACTCCAAAAATCCTGACGATTCAATCATGAAACCAGAAGCAAGGCCATATGGTTGGTTA
CTGAACCTCGAGGATCATGCAATGTGA
```

SEQ ID NO: 48, Oryza sativa Orysa_GRF_Os03g47140.1 translated polypeptide sequence
```
MFADFSAAAMELGEVLGLQGLTVPSTKEGDLSLIKRAAAGSFTQAAAASYPSPFLDEQKMLRFAKA
AHTLPSGLDFGRENEQRFLLSRTKRPFTPSQWMELEHQALIYKYLNAKAPIPSSLLISISKSFRSS
ANRMSWRPLYQGFPNADSDPEPGRCRRTDGKKWRCSKEAMADHKYCERHINRNRHRSRKPVENQSR
KTVKETPCAGSLPSSVGQGSFKKAKVNEMKPRSISYWTDSLNRTMANKEKGNKAAEENNGPLLNLT
NQQPTLSLFSQLKQQNKPEKFNTAGDSESISSNTMLKPWESSNQQNNKSIPFTKMHDRGCLQSVLQ
NFSLPKDEKMEFQKSKDSNVMTVPSTFYSSPEDPRVSCHAPNMAQMQEDSISSSWEMPQGGPLGEI
LTNSKNPDDSIMKPEARPYGWLLNLEDHAM
```

SEQ ID NO: 49, Oryza sativa Orysa_GRF gi_115447910 ref_NM_001054270.1 nucleic acid sequence
```
GACAACTCACTGCCCCCATCTTCTTTCTTCATTCCTCTTCCCACCAAGAACCCCAAACCTTACCT
CCATTGAGTTCGAAACCGAGGAGCGAGGAGTTACAAGCCGAGTTGTCAGAATGGATGAGGAGAAGG
AAGCCGACTCGCCGCAGCCACCGTCCAAGCTGCCTCGCCTCTCCGGCGCTGACCCGAATGCCGGAG
TGGTGACCATGGCAGCACCCCCGCCGCCGGTGGGTCTTGGGCTGGGGCTTGGACTCGGCGGCGACA
GCCGCGGCGAGCGTGACGTGGAAGCGTCGGCGGCGGCGGCGCACAAGGCGACGGCGCTGACGTTCA
TGCAGCAGCAGGAGCTGGAGCACCAGGTGCTCATCTACCGCTACTTCGCCGCGGGCGCGCCCGTGC
CGGTGCACCTCGTGCTCCCCATCTGGAAGAGCGTCGCGTCCTCCTCCTTCGGCCCGCACCGCTTCC
CTTCCCTGGCAGTGATGGGGTTGGGGAACCTGTGCTTCGACTACCGGAGCAGCATGGAGCCGGACC
CAGGGCGGTGCAGGCGCACGGACGGCAAGAAGTGGCGGTGCTCGCGCGACGTGGTGCCGGGGCACA
AGTACTGCGAGCGGCACGTCCACCGCGGACGCGGCCGTTCAAGAAAGCCTGTGGAAGCCTCCGCGG
CCGCCACCCCGGCGAACAACGGCGGCGGCGGTGGCATCGTCTTCTCCCCCACCAGCGTCCTCCTCG
CCCACGGCACCGCGCGCGCCACCTGACCAGTGACCAGACCGGCGCCCGTTTGTTTGTTTGTCTCGG
CGCATGGGAAAACCCAAATCCGCAGGGATTATGTCATGTCCTGTAACTCTTTTTTTCCTCGCAACT
TTTGAAGCCAAAACAATTCTCACCGTGTTCGATGGC
```

SEQ ID NO: 50, Oryza sativa Orysa_GRF gi_115447910 ref_NM_001054270.1 translated polypeptide sequence
```
MDEEKEADSPQPPSKLPRLSGADPNAGVVTMAAPPPPVGLGLGLGGDSRGERDVEASAAAAHKA
TALTFMQQQELEHQVLIYRYFAAGAPVPVHLVLPIWKSVASSSFGPHRFPSLAVMGLGNLCFDYRS
SMEPDPGRCRRTDGKKWRCSRDVVPGHKYCERHVHRGRGRSRKPVEASAAATPANNGGGGIVFSP
TSVLLAHGTARAT
```

SEQ ID NO: 51, Oryza sativa Orysa_GRF gi_115460325 ref_NM_001060298.1 nucleic acid sequence
```
ATGCCCTTTGCCTCCCTGTCGCCGGCAGCCGACCACCGGCCCTCCTTCATCTTCCCCTTCTGCCGC
TCCTCCCCTCTCTCCGCGGTCGGGGAGGAGGCGCAGCAGCACATGATGGGCGCGAGGTGGGCGGCG
GCGGTGGCCAGGCCGCCGCCCTTCACGGCGGCGCAGTACGAGGAGCTGGAGCAGCAGGCGCTCATA
TACAAGTACCTCGTCGCCGGCGTGCCCGTCCCGGCGGATCTCCTCCTCCCCATCCGCCGTGGCCTC
```

FIGURE 5 (continued)

GACTCACTCGCCTCGCGCTTCTACCACCACCCTGTCCTTGGATACGGTTCCTACTTCGGCAAGAAG
CTGGACCCGGAGCCCGGACGGTGCCGGCGTACGGACGGCAAGAAGTGGCGGTGCTCCAAGGAGGCC
GCGCCGGACTCCAAGTACTGTGAGCGACACATGCACCGCGGCCGCAACCGTTCAAGAAAGCCTGTG
GAAGCGCAGCTCGTCGCCCCCACTCGCAGCCCCCGCCACGGCGCCGGCCGCCGTCACCTCC
ACCGCCTTCCAGAACCACTCGCTGTACCCGGCGATTGCTAATGGCGGCGGCGCCAACGGAGGCGGT
GGTGGTGGTGGCGGTGGCGGCAGCGCGCCTGGCTCGTTCGCCTTGGGGTCTAATACTCAGCTGCAC
ATGGACAATGCTGCGTCTTACTCGACTGTTGCTGCTGGTGCCGGAAACAAAGATTTCAGGTATTCT
GCTTATGGAGTGAGACCATTGGCAGATGAGCACAGCCCACTCATCACTGGAGCTATGGATACCTCT
ATTGACAATTCGTGGTGCTTGCTGCCTTCTCAGACCTCCACATTTTCAGTTTCGAGCTACCCTATG
CTTGGAAATCTGAGTGAGCTGGACCAGAACACCATCTGCTCGCTGCCGAAGGTGGAGAGGGAGCCA
TTGTCATTCTTCGGGAGCGACTATGTGACCGTCGACTCCGGGAAGCAGGAGAACCAGACGCTGCGC
CCCTTTTTCGACGAGTGGCCAAAGGCAAGGGACTCCTGGCCTGATCTAGCTGATGACAACAGCCTT
GCCACCTTCTCTGCCACTCAGCTCTCGATCTCCATTCCAATGGCAACCTCTGACTTCTCGACCACC
AGCTCACGATCACACAACGATGAGTGA

SEQ ID NO: 52, Oryza sativa Orysa_GRF gi_115460325 ref_NM_001060298.1_ translated polypeptide sequence
MPFASLSPAADHRPSFIFPFCRSSPLSAVGEEAQQHMMGARWAAAVARPPPFTAAQYEELEQQALI
YKYLVAGVPVPADLLLPIRRGLDSLASRFYHHPVLGYGSYFGKKLDPEPGRCRRTDGKKWRCSKEA
APDSKYCERHMHRGRNRSRKPVEAQLVAPHSQPPATAPAAAVTSTAFQNHSLYPAIANGGGANGGG
GGGGGGGSAPGSFALGSNTQLHMDNAASYSTVAAGAGNKDFRYSAYGVRPLADEHSPLITGAMDTS
IDNSWCLLPSQTSTFSVSSYPMLGNLSELDQNTICSLPKVEREPLSFFGSDYVTVDSGKQENQTLR
PFFDEWPKARDSWPDLADDNSLATFSATQLSISIPMATSDFSTTSSRSHNDE

SEQ ID NO: 53, Oryza sativa Orysa_GRF gi_115471984 ref_NM_001066126.1 nucleic acid sequence
GAGAGCTCCGTATCACCGGCCTCTTTCCCTTCCCTTCCCCTCCGATCCAATCCCCCCTTCTCCTCC
TCGCGGCGCTCGCTGAGCATGGCGGCGGAGGGGGAGGCCAAGAAGGACAGCGCCAGCAACCCTCCC
GGGGGAGGAGGCGGCGGAGGTGGAGGGGAGGAGGAGGAGGATAGCAGCCTGGCTGTCGGGGAGGCG
GCGGTCGGGGTGGGCGAGGCTGGTGGAGGAGGAGGAGGAGGGGAGAAGGCGGATCGAGAGGAGGAG
GAGGGGAAGGAGGATGTGGAGGAGGGCGGCGTGTGTAAGGATCTGGTGCTCGTCGAGGACGCCGTC
CCCGTCGAGGATCCGGAGGAAGCCGCAGCAACTGCAGCACTTCAGGAAGAAATGAAAGCGCTCGTT
GAATCCGTCCCAGTTGGTGCTGGGCGGCATTCACCGCGATGCAACTACAGGAGCTTGAGCAGCAA
TCTCGTGTCTACCAGTATATGGCTGCCCGTGTGCCTGTGCCTACTCATCTCGTCTTCCCAATATGG
AAGAGTGTTACTGGTGCATCTTCTGAAGGCGCCCAGAAGTACCCGACATTGATGGGGTTGGCAACA
CTCTGCTTGGACTTTGGAAAGAACCCAGAACCAGAACCTGGGAGGTGCCGGCGAACTGATGGAAAG
AAGTGGCGGTGCTGGAGAAATGCAATTGCAAATGAGAAATATTGCGAACGCCATATGCACCGTGGC
CGCAAGCGTCCTGTACAGCTTGTTGTCGAGGATGACGAGCCTGATTCTACCTCAGGGTCGAAACCA
GCATCTGGCAAGGCCACCGAAGGTGGCAAGAAGACTGATGACAAGAGCTCAAGTAGCAAGAAGCTT
GCAGTGGCAGCACCAGCTGCTGTGGAGTCTACATGATTGATGCAGCATTTAGGAGCTGCATAAAGA
GCATAACTGTGCTGGCAATTAGAGTTCGCTTCTTATTGTAATCCTGAAAAGACTGTAGTCTGGTCT
AGCTATAACCTCATCAAGCAAGAAAGTGTCTGTGGAAAGAAGCCACAAAAACTTTCATTTAGCTG
TCACTGAAATTTTCAGTTTAGGTGTATAGTTTGATTTAGCTTTGCCGTGCCCTCTGCCTTCAGGCA
GATGAGCGGCATTATTGGATAAATCCTCTCTGACTGACAATATCGCATTGTGACTCAAGAAGCCGA
TGGAAGGATCTGCGAGACTAGATACGAAGCTATTTGTTGTGTATCATTTTATATGGCCTGCACAAT
TGTGTGATTTTGTCAGTTGCATAACATGTGGAAGATCCATAATTTTATGCACTATGGAGATTCAAT
TACCTTCCTGAATGTCTGAGCTTCGACATGTTATTGGTTATTGTAACTTAAAAGCAACCTGAGATT
CAATGTGAAAGGGTTTTAGATTCCAGCTTC SEQ ID NO: 54, Oryza sativa Orysa_GRF gi_115471984 ref_NM_001066126.1_ translated polypeptide sequence
MAAEGEAKKDSASNPPGGGGGGGGGEEEEDSSLAVGEAAVGVGEAGGGGGGGEKADREEEEGKEDV
EEGGVCKDLVLVEDAVPVEDPEEAAATAALQEEMKALVESVPVGAGAAFTAMQLQELEQQSRVYQY
MAARVPVPTHLVFPIWKSVTGASSEGAQKYPTLMGLATLCLDFGKNPEPEPGRCRRTDGKKWRCWR
NAIANEKYCERHMHRGRKRPVQLVVEDDEPDSTSGSKPASGKATEGGKKTDDKSSSSKKLAVAAPA
AVEST SEQ ID NO: 55, Populus tremuloides Poptr_GRF_ lcl_scaff_XIV.39 nucleic acid sequence
TAGTGAAGCTCCTTCTCATGTCTCACCTCCTGAGACCAAACCAAAGATTCTTGGATCTGTGTTAAG
TAAGCGAGAAAGATCAGCTTCGTCTGCTCAAGATGATTACTGGAGGACTTCAAAGATGCCAAAAAA
TGATGATTTTTCTGTCACCAAAACAATGTCGTTGCACCAACCCACTTCTTTACTGAGATCTAATTA
CATGCTTTCTGATGATTCTCGCCAACAAGAGCACATGATGAGCTTCTCTTCTCCAAGACCAGAAAC
GACTCCATTTCTAAGCAAAGATGGTGAGTTAGTGGAGAGAAGCACACAAAACCACACTGCCTTAAG
CTTTCGTTACCATCAGAACACAGCTTCTTCTTATATTAGAAGTGCAGGTTATGACACCGGAGGCTT
GAATGCAGGCATGCACGGGCCTCTTACTGGGGTTAGAGGACCATTTACTCCATCTCAGTGGATGGA
GCTTGAACATCAGGCCTTGATCTACAAATACATCACTGCTCGTGTGCCTGTGCCTTCTAATTTGAT
CATTCCTCTCAAGAAGTCTGTCTACCCTTATAGCTTACCTGGCTCCTCTACTGGATCCTTCCCTCA
CAATTCATTGGGATGGAGCGCTTTCCATCTTGGTTACCCTGGCAACAACACTGATCCGGAGCCTGG
AAGGTGTCGTCGGACTGATGGGAAGAAATGGCGGTGCTCAAGGGATGCTGTAGCTGACCAAAAGTA
TTGTGAAAGGCACATAAACAGAGGCCGCCATCGTTCAAGAAAGCCTGTGGAAGGCCAGACTGGCCA
TGCTGCCACTGGGACTGCCAGTTCAAAGGTGGTGCCAATGTCGAACTCGATGTCAAAATTGGCAAT
AACCAGTGGTGGTGCCTCCAACAGCATTGCGATGACCACGCAACAACAGTTCAAAATTTTGCAGCC
GGCTGCTGCCAACACTTCTGCAGATGTTGATGTCAACAGAGCACAAGATGCACAGAGCATTTCTAT
GATGTCTTCCACCATCAACCGGAAATCTGATGAGTCCTCTTTCTTTGTTCCTAAACAAGATATCTT
AATGGAGCAGTGCTCTCAAACAGAGTTTGGATTTGTCTCCTCTGACTCTCTCCTCAACCCATCGCA
GAAGAGCTCTTACATTAACTCTAAGCCCTACGAGTCTTTTCTAAACTTTAATGACGAAGAAAGCCA
AGATCAGCATCCCCTTCGTCAATTCATTGATGAGTGGCCGAAGGATCAATCTAATTGTTCTGTCAT
TAGCTGGCCAGAAGAGTTGAAATCTGACTGGACCCAGCTCTCCATGTCAATCCCAATGGCCTCATC
AGACTTCTCATCATCATCATCCTCACCCACACAAGAGAAACTTGCCCTCTCACCAATGAGTTTATC
TTGCGAGTTTGACCCTGTACAAATGGGTTTAAGGGTGAGCGTTGACCATAATGAATCAAGCCAAAA
GCAAACCAACTGGATACCTATCTCCTGGGGACTTCAATTGGTGGCCCTTTAGGAGAGGTCTTGAC
CACCAGCACTAGCCATGCGGATTCCTGCAAGAGCTCATCAGCCCTTAGCCTTTTGAGAGAAGGTTG
TGATGGCAGCCCACAGTTGGGATCTTCTCCGACGGGAGTCTTGCAGAAATCAACTTTCTGTTCCCT
TTCCAATAGCAGTTCTGGGAGCAGCCCAAGAGCTGAGAGCAAGAAAAACAATGACACTGCTAGTCT
GTATGAGGATGTGGGTGGTTCGATAATTGCAAGTTCATCACCTATTCCACCCCTGTAATCAAGCGA
ACTGTAAGGATGAAACCTGTCAAGGAAATGTGAAGAAGCTTGGAGTTTCTATTTATCTGATAAATT
CCTGTA SEQ ID NO: 56, Populus tremuloides Poptr_GRF_ lcl_scaff_XIV.39 translated polypeptide sequence
MDFGVLGLEGLVGPETSSEAPSHVSPPETKPKILGSVLSKRERSASSAQDDYWRTSKMPKNDDFSV
TKTMSLHQPTSLLRSNYMLSDDSRQQEHMMSFSSPRPETTPFLSKDGELVERSTQNHTALSFRYHQ
NTASSYIRSAGYDTGGLNAGMHGPLTGVRGPFTPSQWMELEHQALIYKYITARVPVPSNLIIPLKK
SVYPYSLPGSSTGSFPHNSLGWSAFHLGYPGNNTDPEPGRCRRTDGKKWRCSRDAVADQKYCERHI
NRGRHRSRKPVEGQTGHAATGTASSKVVPMSNSMSKLAITSGGASNSIAMTTQQQFKILQPAAANT
SADVDVNRAQDAQSISMMSSTINRKSDESSFFVPKQDILMEQCSQTEFGFVSSDSLLNPSQKSSYI

FIGURE 5 (continued)

NSKPYESFLNFNDEESQDQHPLRQFIDEWPKDQSNCSVISWPEELKSDWTQLSMSIPMASSDFSSS
SSSPTQEKLALSPMSLSCEFDPVQMGLRVSVDHNESSQKQTNWIPISWGTSIGGPLGEVLTTSTSH
ADSCKSSSALSLLREGCDGSPQLGSSPTGVLQKSTFCSLSNSSSGSSPRAESKKNNDTASLYEDVG
GSIIASSSPIPPL

SEQ ID NO: 57, Populus tremuloides Poptr_GRF_ lcl_scaff_II.1070 nucleic acid sequence
AAGTAATAGTGGTTTCGCTTCTCTTGCTAGTTCAGATCCTGAAGCAAAGCAGAAGTACGGATCTGG
GTTCCTGAAGCAAGAGAGATCTGCCGCAGCCGATGACGATTGGAGGAACTCTAAATTGGCCAAAAC
CGAGTCAATGCTGCTTGACCAGAGAAACACTTTTCTTCTGAAATCTAGCAACAACTCTCTCTTCAC
TGATGGACAGCAGCAGCAGCAGATGCTCAGCTTCTCCTGTCCCAAATCAGCTTCTTCAGGGGAGAG
AAGCTCCCCAAATGCCATGTTGCCATACTTTCACCTCACATCTTCTGCTTGTAATAGAAATACAGG
CTACAACTCTGGAATCTTCAATGCTGCCAGCATGCATGGGGTTTTGACTGAGACTAGATGGCCATT
CACTCAATTACAATGGATGGAGCTTGAACATCAGGCCTTGATCTACAAATACATGACTGCAAATGT
GCCTATACCATCTAATCTGCTCATCCCCATTAGGAAAGCTCTTGATTCTGCTGGGTTTTCTAGCTT
TTCTGGTGGACTTTTCAAACCCAGTGCATTGCAATGGGGTACTTTCCATATGGGTTTCTCCAGCAA
CACTGATCCGGAGCCAGGACGGTGTCGAAGAACAGATGGGAAGAAATGGCGGTGCTCAAGAGACGC
AGTTGCTGATCAGAAGTATTGTGAGCGGCACATGAACAGGGGTCGCCATCGTTCAAGAAAGCCTGT
GGAAGGACAATCAGGCCATTCCGCTGCGGCCACCACCACTTTAAAGCCAATGGCCAATGGCACTTC
CTCTTTTGCATCAGCATCAGTGGTGGGGCTTCGCAGCGCTGTGTCCGACAGCCACACTATTGTGCA
TAATCAGCAGCAACCTGCCAGTTCTTCTAATCTTTCTGCCACCAATACGCTCAGCAGGGTGTTCCT
CGCTACAGAGAATGTAGGTGAGAGAATGCAAGATGCATCGGGCTTATCCATGCTACCATCCAGCAT
TGACCTGAAATCCAAAGAAACTCCATTCTTCATATCAAAACAACAGAACTCTTACGGTGAATCCCT
GCAAAATGAGTTTGCACTTGTCACCTCCGACTCCCTCCTCAACCATTCACAGAAAAGCTCGTCCTT
GATGAGTTGCAGAAATTTTGGTTCGTCTCAGGACCTTACTGACCAGGAATCTGTTTCACAGCACTC
CCTCCGCCAATTTATGGATGATTGTCCTAAAAGTCATTCTGATCGCTCTGCTGTTGCTTGGCCTGG
ACTTGATCTGCAATCTGAGAGAACCCAGCTATCAATTTCAATCCCCATGGCTCCTGCAGACTTTGT
GTCATCCACTTCATCTTCAAACAATGAAAAGATCTCTCTCTCCCCGCTGAGATTATCGCGTGAATT
TGATCCAATAAAGATGGGGCTGGGAGTGGGAGCCGGTAGTGTCGCCAATGAACCAAACCAAAGGCA
AGCGAATTGGATTCCCATTTCTTGGGAAACTTCAATGGGTGGTCCACTTGGGGAGGTTTTGCACAA
CACCAATAATAATGCAACAGCAGAATGCAAGAATGAATCATCGCTCAACCTAATGACAGAGAGATG
GGACAACAGTCCTCGGGTAGGCTCATCTCCTACCGGGGTCTTACAAAAGTCTGCCTTTGCTTCTCT
TTCAAATAGCAGTGCTGGAAGCAGCCCAAGAGCAGAGAACAAGACCATTGAAGGTGGCAATCTCTG
CAATGACCTTGGATCTACTATCGTGCATTCTTCATCATTGCCTGCCTTGTAACTCTCTGACCTGCC
ATTTAAGAAGTCTTCAGCTGATGCCAGATTATGAATAATTTGTTTTTTAAAGTTCTCAATCAGTCT

SEQ ID NO: 58, Populus tremuloides Poptr_GRF_ lcl_scaff_II.1070 translated polypeptide sequence
MDFGVQVGLDGLVGSDTSNSGFASLASSDPEAKQKYGSGFLKQERSAAADDDWRNSKLAKTESMLL
DQRNTFLLKSSNNSLFTDGQQQQQMLSFSCPKSASSGERSSPNAMLPYFHLTSSACNRNTGYNSGI
FNAASMHGVLTETRWPFTQLQWMELEHQALIYKYMTANVPIPSNLLIPIRKALDSAGFSSFSGGLF
KPSALQWGTFHMGFSSNTDPEPGRCRRTDGKKWRCSRDAVADQKYCERHMNRGRHRSRKPVEGQSG
HSAAATTTLKPMANGTSSFASASVVGLRSAVSDSHTIVHNQQQPASSSNLSATNTLSRVFLATENV
GERMQDASGLSMLPSSIDLKSKETPFFISKQQNSYGESLQNEFALVTSDSLLNHSQKSSSLMSCRN
FGSSQDLTDQESVSQHSLRQFMDDCPKSHSDRSAVAWPGLDLQSERTQLSISIPMAPADFVSSTSS
SNNEKISLSPLRLSREFDPIKMGLGVGAGSVANEPNQRQANWIPISWETSMGGPLGEVLHNTNNNA
TAECKNESSLNLMTERWDNSPRVGSSPTGVLQKSAFASLSNSSAGSSPRAENKTIEGGNLCNDLGS
TIVHSSSLPAL

FIGURE 5 (continued)

SEQ ID NO: 59, Populus tremuloides Poptr_GRF_ lcl_scaff_I.1018 nucleic acid sequence
ATGGCAAGAGCTTGAACACCAAGCTCTCATTTACAAATACATGGTCTCTGGTGTTCCTGTCCCGCC
AGAACTCCTCTATTCTGTCAAAAGAAGCTTGGGATCTTCTTTGGCATCAAGACTCTTCCCTCACCA
ACCTATTGGGTGGGGTTGTTTTCAGGCGGGTTTTGGCAGAAAAGCAGACCCAGAGCCAGGAAGGTG
CAGAAGAACGGATGGAAAAAAATGGAGGTGCTCAAAGGAAGCATACCCAGACTCAAAATATTGTGA
GAGGCACATGCACAGAGGCAGAAGCCGTTCAAGAAAGCCTGTGGAACTTACTTCAAGTACTACTAC
AACAGCAACAACAATTCCTTTAACATCAATAACAGAAACCTCTCTAACCCCACTATTTCACCCTC
CAGCTCCTCTTATTCTTTCTCACCCTTCATCTGCGGAATCTGAAGTTTATGCCCATCAAAACCC
TTCGCATGGAACCTTCCTTAACCCCTTCCTTTATCCTCATTCTTCATCTTCTGGACCTCCTGATTC
TGGTTTTTCACCTCTAAATAGCACCCCTCACAACCTGTTTTGGAGTCTGGATCTTCTCCTCAAGT
TGACAAAGAGCACAGGTATTATCATGGAATGAGGGAGGATGTGGATGAGAGAGCTTTCTTTCCAGA
TGGTTTAGGGAGTGCAAGAGGTGTTCAAGATTCATATAACCAATTGACAATGAGTTCCTACAAAGG
TTACTCACTGTCACAGTTTCAAACCTTTGCTGATACTTCTAAAGAAGAGCAGCAACAACCAGGGCA
GCACTGCTTTGTTTTGGGCACTGATATTATCAAGTCATCAGCAACAAGGTCAATCAAGTTGGAGAA
AGAAACTGAAACCCTGAAGCCATTGCACCATTTCTTTGATGAATGGGAACCAAAGGACGCAGACTC
TTGGCTTGATCTTGCATCCAGTTCAAGACCTCACACTTCTGATGATTGAAGTCTCAATAATGGATC
TTTGTAATATGACGAAAACAGTACTTGTTCGTGGGTCATCAATGCCTTTCTTGCCTCAAATGA

SEQ ID NO: 60, Populus tremuloides Poptr_GRF_ lcl_scaff_I.1018 translated polypeptide sequence
MLNTTISRNRFPFTATQWQELEHQALIYKYMVSGVPVPPELLYSVKRSLGSSLASRLFPHQPIGWG
CFQAGFGRKADPEPGRCRRTDGKKWRCSKEAYPDSKYCERHMHRGRSRSRKPVELTSSTTTTATTI
PLTSINRNLSNPTISPSSSSYSFSHPSSAESEVYAHQNPSHGTFLNPFLYPHSSSSGPPDSGFSPL
NSTPHNLFLESGSSPQVDKEHRYYHGMREDVDERAFFPDGLGSARGVQDSYNQLTMSSYKGYSLSQ
FQTFADTSKEEQQQPGQHCFVLGTDIIKSSATRSIKLEKETETLKPLHHFFDEWEPKDADSWLDLA
SSSRPHTSDD

SEQ ID NO: 61, Populus tremuloides Poptr_GRF_lcl_scaff_28.10 nucleic acid sequence
TCTTCTTTTCTCTTCCAGGGTAATATGATAATGAGTGGAGGAAACAGGTTTCCCTTCACTGCATCC
CAGTGGCAAGAGCTTGAGCATCAAGCCCTAATCTACAAGTACATGGTTTCAGGCATCCCCATCCCT
CCCGATCTTCTTTTCACCATCAAAAGAAGTGGCTGCTTGGACTCTTCACTCTCTTCAAAGCTCTTT
CCTTGCCAACCTCCACATTTTTCCTGGGCTGTTTTCAGATGGGTTTGGAAGGAAAATAGATCCA
GAACCGGGGAGGTGCAGGAGAACTGATGGAAAGAAATGGAGATGCTCAAAAGAAGCATACCCAGAT
TCTAAGTACTGTGAGAAACATATGCATAGAGGGAAGAACCGTTCAAGAAAGCCTGTGGAAGTTGCA
ACACAATCAATAACAGCACCAACTGTCTCATCAATGACCAGAAACCACTCTAATAATTCACTACTA
ACAACATCCCCCACCTCTCTTTCGTTATTGTCACCTAAGACCCACCACCAGAATCACCTTCACTAT
CCTGCTCCTGCAGGTTATCATGCCCATCCAAATCATCAATTCTTGTCTTCTTCCAGACCCCTTGGG
ATTGGTCTGTCCCCTCATGAAAATCCTACTCACTTGCTTTTGGACTCTGGTGGTTCTTCTCTGGCC
AATACAGATTACAGAAGAAACAGGAATGTTTATGGGCTGAAAGAGGAGGTTGATGAGCATGCTTTC
TTCTCAGAACCTTCAGGTTCTATGAGAAGCTTGTCCGGTTCATCTTTGGATGATGCTTGGCAACTC
ACCCCACTCACAATGAACTCTTCTCCTTCTACCACCAACTCTTCAAAGCAAAGGAGCTTGTCTAGT
TTACACAACGAATATTCTTACTTGCAGCTTCAAAGCCTGAGTGATCCCGATACCCCAAAACAACAA
AAGCAGTGTCAACATAACTATCTTCTGGGAAGTAGTGATGTAGACAGTCTAGGGCCCATAAAAATG
GAGAAGGAAAAATCCCAAAAGACTGTTCACCGTTTCTTTGATGAATGGCCACCAAAGGATAAAGAT
TCATGGCTTGATTTGGATGACAAATCATCAAAAAGTGCATCAGTTTCAGCAACCGGACTCTCAATA
TCCATTCCCTCCTCTCATGACTTTCTTCCAATCTTCAGTTCAAGAACTAATAATGGTGGTTGATTT
TACTCTGGTGGGTTTCTGGCCCAAGATGTACTTGGTGGGAAGGGGGGGGTCACCGCCTTCTGTCAA
GAGGCCTCAGA

SEQ ID NO: 62, Populus tremuloides Poptr_GRF_lcl_scaff_28.10 translated polypeptide sequence
MIMSGGNRFPFTASQWQELEHQALIYKYMVSGIPIPPDLLFTIKRSGCLDSSLSSKLFPCQPPHFS
WGCFQMGLGRKIDPEPGRCRRTDGKKWRCSKEAYPDSKYCEKHMHRGKNRSRKPVEVATQSITAPT
VSSMTRNHSNNSLLTTSPTSLSLLSPKTHHQNHLHYPAPAGYHAHPNHQFLSSSRPLGIGLSPHEN
PTHLLLDSGGSSLANTDYRRNRNVYGLKEEVDEHAFFSEPSGSMRSLSGSSLDDAWQLTPLTMNSS
PSTTNSSKQRSLSSLHNEYSYLQLQSLSDPDTPKQQKQCQHNYLLGSSDVDSLGPIKMEKEKSQKT
VHRFFDEWPPKDKDSWLDLDDKSSKSASVSATGLSISIPSSHDFLPIFSSRTNNGG

SEQ ID NO: 63, Populus tremuloides Poptr_GRF_ lcl_scaff_I.995 nucleic acid sequence
CTAGGGACTGGACTGCTAAACGGTTGGAACATGGAGGGAAATAGGCGCAATGGTCGGTCTCGGTCA
CCTTCAATTGGGCTAGGAGTTGAGCTTGGACGTGGTGGTTCTAGTCAAAGACCAATAACTGGCTGC
AAAAAACCTTATGGGTTCACTATTCTTCAACTGCATGAGCTAGAACTTCAGTCTCTTATCTACAAG
TATATCCAAGCTGGATTTCCTGTACCTTACCATCTTGTTTTACCTATATGGAAAAGTGTTACTGCT
TCCCTTGGTGGTCTCAGTTCAAGCTTGTACCAGCTCTACCCTAGCTTTATGGGGTGTAAGTGTAAC
CCATTATATTTGGAATATAAGAAAGGAATGGAACATGAGCCAGGGAGATGTAGGAGAACGGATGGA
AAGAAGTGGAGGTGTAGCAAAGAGGTTCTTCCAGATCAAAAGTACTGTGACAGGCACATACACAGA
GGACGCCAGCGTTCAAGAAAGCTTGTGGAAGCTGCTTCTCATAGTAATGCCAGCACCAACCTCTCC
ATTTCTCTCCCTGGAATCGGTAGTGCTAGCGCCAGCAGTACTAATCTCTCTCCAATATGTTGTCT
CTCTCCAAAGAGTGTTCTCCACAAGAAATATGTAATAGGAGCAGCTGCTA

SEQ ID NO: 64, Populus tremuloides Poptr_GRF_ lcl_scaff_I.995 translated polypeptide sequence
MEGNRRNGRSRSPSIGLGVELGRGGSSQRPITGCKKPYGFTILQLHELELQSLIYKYIQAGFPVPY
HLVLPIWKSVTASLGGLSSSLYQLYPSFMGCKCNPLYLEYKKGMEHEPGRCRRTDGKKWRCSKEVL
PDQKYCDRHIHRGRQRSRKLVEAASHSNASTNLSISLPGIGSASA

SEQ ID NO: 65, Populus tremuloides Poptr_GRF_ lcl_scaff_III.741 nucleic acid sequence
CAAGTGAAGTTGAAGAGAGAAGTGAAAGAAATGAGCAACTCATCAGTCACAGTGGCGGGGGTGGGA
TCAAGATCACCACCAGGTTTCACGATGTCTCAGTGGCATGAGCTGGAGCATCAAGTTCTTATCTTT
AAGTGTTTAAATGCAGGGTTACCTGTCCCTCCTTCCCTTCTCCTTCCTATTCGTAAGAGTTTTCAG
CTTCTTTCCCCTGGTTTCTTGCACCCATCAAATTTGAGCTACTGTTCCTATTTTGGGAAGAAGATT
GACTCAGAGCCAGGGAGGTGTCGGAGGACAGATGGCAAGAAATGGAGGTGCTCCAAAGATGCTCAC
CCAGACTCCAAGTACTGTGAGCGGCATATGAATAGAAGCCGTAACCGTTCAAGAAAGCCTGTGGAA
TCACAAACTACCTCTCAGTCCTTGTCAACTGTGGCATCAGAAATTGCAACTGGGAGCAGCAGCATT
GGGAGCAGAGGGTATCCAACTAATCCTGGGACCTTAGGTTTGGGAAGTAATATGTCACGTTGGCAG
ATGGAGTCTATGCCTTATGGTGTTAATAGTAAAGACTACAGGTCTCTCCATGGACCGAAGCCTGAA
GCAGATGAGAAAACTTTCCTACCAGAAGCTTTGGGAAATACAAGAAGCTTTGGAATGAACTCTACT
GTGGACAGCACTTGGCATCTCACATCCCAAGTCCCTGCAAACCCTGTGCCAGAATCAAGAAATGGT
TCTCTTTTGCAAAACTACCCACAAGTACAGACACTGCAGGATTTTGAGCCCCTAACTGTTGATGCT
GCATCGCCAAAACAACAGCAGCAGCAGCATTATTTATTTGGAAGGGAGTTCAGTTCATCAGGATCT
ATGAGGCGGGAAAATCAGTCTCTTCAGCCTCTCTTTGACGAGTGGCCAAAATGCAGGGATATGGAT
TCCCATCTCACTGATCAAAGATCTAACAATAACTCGTCTGCTGTTCAGCTATCAATGGCCATTCCA
ATGGCTCCTAACCCTGCTGCGAGGAGTTATCATTCCCCAAATGGTGAGACAGGTTTATCTGGAACA
TACTTTTCCGCAACCTAGACGCCCCAAGACTTGGTGGAAAACAAATAGATGAGTTCTAATCCTCT
CATGTTATAATGCAGATGCTTGAAAGGAGCAT

FIGURE 5 (continued)

SEQ ID NO: 66, Populus tremuloides Poptr_GRF_ lcl_scaff_III.741
translated polypeptide sequence
MSNSSVTVAGVGSRSPPGFTMSQWHELEHQVLIFKCLNAGLPVPPSLLLPIRKSFQLLSPGFLHPS
NLSYCSYFGKKIDSEPGRCRRTDGKKWRCSKDAHPDSKYCERHMNRSRNRSRKPVESQTTSQSLST
VASEIATGSSSIGSRGYPTNPGTLGLGSNMSRWQMESMPYGVNSKDYRSLHGPKPEADEKTFLPEA
LGNTRSFGMNSTVDSTWHLTSQVPANPVPESRNGSLLQNYPQVQTLQDFEPLTVDAASPKQQQQQH
YLFGREFSSSGSMRRENQSLQPLFDEWPKCRDMDSHLTDQRSNNNSSAVQLSMAIPMAPNPAARSY
HSPNGETGLSGTYFSAT SEQ ID NO: 67, Populus tremuloides Poptr_GRF_ lcl_scaff_VII.1274
nucleic acid sequence
TAGTCATGCTCCTTCTCATGTCTCACTTCCTGAGACCAAACCAAAGATTCTTGGATCTGTGTTAAC
TAAGCAAGAAAGATCATCTTCATCTGCATCAGCTCAGGATGATTACTGGAGGGCTTCAAAGATGCC
AAAACTTGATGATTTCTCTTCCACCAAAACAATGCCACTGCACCAACCCGCTCCTTTGCTGAGACC
TAATTCTATGTTTTCTAATGATTCTCGCCAACAAGAGCACATGCTAAGCTTCTCTTCTCCAAAACC
AGAAGCTACTCCATTTCTCGTTAAAGATGCTGGCTTGGTTGAGAGAAACACACAAAACCACACTGC
CTTGAGTTTTCCTTACTACCAGCACGCACCTCTTTCCGCTAGCAGAAGTGCAGGTTATGGCACTGG
AAACTTGAATGCAAGCATGCAGGGGCCTTTTACTGGGGTTAGAGGACCATTTACTCCATCTCAGTG
GATGGAGCTTGAACACCAGGCCTTGATCTACAAATACATCACTGCACGTGTGCCTGTGCCTTCCAA
TTTAATCATTCCTCTCAAGAAATCTCTCAACCCTTATGGCTTACCTTTTTCCTCTGCTGGATCATT
CCCTCCCAGTTCATTGGGATGGGGCACTTTCCACCTTGGTTACCCTGGCAACAACACTGATCAGGA
GCCTGGAAGGTGTCGTCGGACTGATGGCAAGAAATGGCGGTGCTCAAGGGATGCTGTAGCTGACCA
AAAATATTGTGAAAGGCACATAAACAGAGGCCGCCATCGTTCAAGAAAGCCTGTGGAAGGCCAGAC
TGGCCATGCTGCTACTGGGACTGCCAGTTCAAAGGTGGTGCCAATGTCTAACTCCATGCCAACCTC
GATTACAACCAGTGGCGCTACCTCGAACAGCATTGTGATCACACAGCAACAGTTAAAAAATTTTCA
GCCGGCTGCTGCTTCCATCTCTTCTGCAGATGCTCGTGTCAACGGAGCACAAGATGCACGGAGGGT
TTCTATGATGTCTTCCACTATCAACCGGAAATCTGACGAGTCTACTTTCTGTATTCCTAGACAAGA
TATCCTATTTGAACAGTGCTCTCAAACAGAGTTTGGACTTGTCTCCTATGATTCTCTCCTCAACCC
ATCGCAGAAGAGCTCTTACTTTAACGCTAAACCCTACGAGTCTTTTCTAAACTTTAGTGATGAAGA
AAGCCATGATCAGCATCCCCTTCGTCAATTCATTGATGACTGGCCGAAGGACCAATCAAATCGTTC
TGTCATTAGCTGGCCAGAAGAGTTGAAATCTGACTGTACCCAGCTCTCAATGTCAATCTCAATGGT
CTCGTCAGACTTCTCGTCGTCATCATCCTCACTTCTGCGAGAGAAACTTGCCTTCTCACCATTGAG
GTTATCTCGCGAGTTTGACCCTATACAAATGGGTTTAAGGGTGAGCGGTGACCATAATGAATCAAG
CCAGAAGCAAGCCAACTGGATACCTATCTCTTGGGGAACTTCAATTGGCGGCCCTTTAGGAGAGGT
CTTGACCACCAGCGCCAGCCATGCGGATTCCTGCAAAAGCTCATCAGCTCTTAACCTTTTAAGAGA
GGGTTGGGATGGCAGCCCGCAGCTGGGATCTTCTCCAACAGGAGTCTTGCAGAAATCGACTTTTGG
TTCACTTTCAAATAGCAGTTCAGGTAGCAGCCCAAGAGCAGAGAGCAAGAAAAACAATGAAAGTGC
TAGTCTGTATGAGGATGTTGTTGGTTCGATAATTGCAAGTGATCCCCTATTCCATCCCTGTAATCA
AGAAAATGGTTAGGATGAAACTTGTGAAGAAGAAGCTTGGAGTTATTTATCTTATTAATTTCTGCA
GACTGTTTCTCCTTGTTGCTTGTTCCC SEQ ID NO: 68, Populus tremuloides Poptr_GRF_ lcl_scaff_VII.1274
translated polypeptide sequence
MPKLDDFSSTKTMPLHQPAPLLRPNSMFSNDSRQQEHMLSFSSPKPEATPFLVKDAGLVERNTQNH
TALSFPYYQHAPLSASRSAGYGTGNLNASMQGPFTGVRGPFTPSQWMELEHQALIYKYITARVPVP
SNLIIPLKKSLNPYGLPFSSAGSFPPSSLGWGTFHLGYPGNNTDQEPGRCRRTDGKKWRCSRDAVA
DQKYCERHINRGRHRSRKPVEGQTGHAATGTASSKVVPMSNSMPTSITTSGATSNSIVITQQQLKN
FQPAAASISSADARVNGAQDARRVSMMSSTINRKSDESTFCIPRQDILFEQCSQTEFGLVSYDSLL FIGURE 5 (continued)

NPSQKSSYFNAKPYESFLNFSDEESHDQHPLRQFIDDWPKDQSNRSVISWPEELKSDCTQLSMSIS
MVSSDFSSSSSSLLREKLAFSPLRLSREFDPIQMGLRVSGDHNESSQKQANWIPISWGTSIGGPLG
EVLTTSASHADSCKSSSALNLLREGWDGSPQLGSSPTGVLQKSTFGSLSNSSSGSSPRAESKKNNE
SASLYEDVVGSIIASDPLFHPCNQENG

SEQ ID NO: 69, Populus tremuloides Poptr_GRF_ lcl_scaff_XII.277 nucleic acid sequence

AAAAATTATTCTTCTTTATTTTTCATCATGATGACAACAGATGATGGCTTAAACGTTTCAAACAAG
GTAGCTAAGGAAATAAACACTACTAGTAGTATTAGTAATGTTGATTTTGGTGTGAAGCTACATCAA
CCTATTGATCATCATCAATCATTTCCTTCTAGTACTCCTATGATGGTTCCTCATGTTAATCACCAC
CGTCCAATGTTTGACAATGGTCCCACATCATCATGTGATAGAAACAAGTCTTTGATGAACTATATA
AGTGATCGTATATACCGTGTTGCTGCTGGTGGTGCTACCAGTGGCGGTGCAGTTGGGGTTAGGAAT
TTGCAGCCTTTTGACATTTCTGAAACAAGTATCTCTACAGCAGCTTCTGCCTTCAGATCCCCAGGA
GGCAACATGGCAGCGTCTTTGGGGTTTCCTTTTACAAATACACAGTGGAAAGAGCTTGAAAGACAA
GCCATGATATACAACTATATAACGGCCTCAGTCCCTGTGCCTCCTCAATTTCTAATTCCAACCCCA
ATGGGGAATGGATTGAATGTAAGGTTCTCAAATGGGGCAGATCTAGAACCAGGGAGGTGTAGGAGA
ACAGATGGGAAGAAATGGAGGTGCTCAAGAGATGTGGCACCTGATCAGAAATACTGTGAGCGTCAT
ATGCATAGAGGCAGACCCCGTTCAAGAAAGCATGTGGAACTCAATGCTAGCAACAATAACAACAAG
AAGAACCGCCATAATCCTGCTATTTGTCCAGAAGCTCCTGTTACCGTGGCCATTTCTAAACCCACA
ATCAACAACAGCAACAGTGGCTCTGCCTCTCACGATCAGTTTTTTGGGCCTATGCCTCAGCCATAT
ATCCAGACCCCAGTTTTTGTAAACAAAACCAGCGAGAAGACTTCAACTTATGATGTTAATGGAGCC
TATGGTTCCACATTCAAAGAACCCAGGAGCTTGGACTGGATGTTGAAGGGGAAGCTGGTCCTATA
GCCAAAAATGATCAACAATGGCCACATCTAGTGCACAAAGAAATTGAACTAGCTACTGAAGGTTCC
TTTAACAGTGCTTCTGTTCTCAAACAGCATTACCAAGGAGAGTCTTTGAATTTGAACTCATTTGGA
AATTTTAATGCTAGAGAAGACCAACAAAGCAATCAATATAGTCTGTTTCTTGATGAGGCTCCAAGG
AGTTTTATTGATGCATGGTCTAATGATGCAATTTCTAGAAACACAAGTTCTGTTTCCTCAGATGGG
AAGCTCCATCTTTCCCCTCTCAGTCTATCAATGGGAAGCAATAGGTCTACTGATGATGAAATGGGT
CAGATCCAAATGGGTTTAGGCCTAATCAAATCAGATCGAAATGAAGAATGTGGTAACACTAGCAGC
GCCCCAGGTGGCCCCTTGGCAGAGGTGTTACAACTGAGGACAAGCAACACCACAGGAACCAATCAA
TCTTCTTCTATGATGGAAAATGGTGATTCTATTAGTCCTCCAGCTACTACAGTCTCTTCTCCATCT
GGGGTTTTGCAGAAAACACTTGCCTCATTTTCTGATAGCAGTGGTAATAGCAGTCCAACTCTTGCC
AGTTCAAGGACCAAACCTGAAATTGCCATGCTTTGGTTAAATCAAGGCTAAATGTGCCACTCTCTA
GTTAGTTAAGGGCACACAAGGCCATAAGGGCAATATAAATTTTTATAAGCTTGATATATTTTTAT

SEQ ID NO: 70, Populus tremuloides Poptr_GRF_ lcl_scaff_XII.277 translated polypeptide sequence

MMTTDDGLNVSNKVAKEINTTSSISNVDFGVKLHQPIDHHQSFPSSTPMMVPHVNHHRPMFDNGPT
SSCDRNKSLMNYISDRIYRVAAGGATSGGAVGVRNLQPFDISETSISTAASAFRSPGGNMAASLGF
PFTNTQWKELERQAMIYNYITASVPPQFLIPTPMGNGLNVRFSNGADLEPGRCRRTDGKKWRCS
RDVAPDQKYCERHMHRGRPRSRKHVELNASNNNNKKNRHNPAICPEAPVTVAISKPTINNSNSGSA
SHDQFFGPMPQPYIQTPVFVNKTSEKTSTYDVNGAYGSTFKEPRSLDWMLKGEAGPIAKNDQQWPH
LVHKEIELATEGSFNSASVLKQHYQGESLNLNSFGNFAREDQQSNQYSLFLDEAPRSFIDAWSND
AISRNTSSVSSDGKLHLSPLSLSMGSNRSTDDEMGQIQMGLGLIKSDRNEECGNTSSAPGGPLAEV
LQLRTSNTTGTNQSSSMMENGDSISPPATTVSSPSGVLQKTLASFSDSSGNSSPTLASSRTKPEIA
MLWLNQG

FIGURE 5 (continued)

SEQ ID NO: 71, Populus tremuloides Poptr_GRF_ scaff_XIII.769 nucleic acid sequence
AGCAGCGGGGATGGCAGCTGGGGGAATGGGGACAGCAGCGATGACAATGAGGTCACCATTTACAGT
GTCACAGTGGCAAGAACTGGAACATCAAGCTTTGATCTATAAGTACATGGTGGCAGGTCTGCCTGT
TCCACCTGATCTTGTGCTCCCTATTCAGAGGAGCTTTGAATCCATTTCTCATAGATTCTTCCACCA
TCCCACCATGAGCTATTGCACTTTCTATGGCAAGAAGGTGGATCCGGAACCAGGTCGATGCAGGAG
GACCGACGGCAAGAAGTGGAGGTGCTCCAAGATGCCTACCCAGACTCCAAGTACTGTGAGCGCCA
CATGCACCGTGGCCGCAACCGTTCAAGAAAGCCTGTGGAATCACAAACCATGACACAGTCATCGTC
CACCGTGACATCACTGACTGTTACAGGAAGCAGCAGTGGAACTGGAAGCTTCCAGAACCTTCCATT
GCACACATATAGCAATCCCCAGGGCACTGCTTCTGGAACTAACCAATCATATTATCATATGAACTC
CATTCCCTACGGAATCCCAACCAAAGATTACAGGTATCTTCAAGAACTTACGCCTGAAGGTGGGGA
GCATAGCTTCTTGTCTGAAGCCTCAGGAAGCAACAAGGGGCTTCAGATAGACTCACAGCTGGACAA
TGCATGGTCTTTGATGCAATCCAGAGTCTCATCATTCCCCACAGAGAAATCAACTGAAAACTCGAT
GTTGCAAAGTAATCATCCCCAGCATTCATTTTTCAGTAGTGATTTCACCACCAGGGAATCTGTGAA
ACAGGACGGGCAGTCTCTTCGACCCTTCTTTGATGAGTGGCCTAAAAACCGAGATGCCTGGTCTGG
CCTCGAGAATGATAGTTCCAACCAGACCTCATTCTCTACAACGCAGCTGTCGATATCCATTCCAAT
GGCCTCATCTGACTTCTCCACAAGTTGTCGTTCTCCACGAGATAACTAAGAGGACACTAAGAATTC
ACAAAACAAAGCCAAAGGTGGTCCTGGCCAAAGATTAACACATACTTGTGTTAAATTTTTGTG

SEQ ID NO: 72, Populus tremuloides Poptr_GRF_ scaff_XIII.769 translated polypeptide sequence
MAAGGMGTAAMTMRSPFTVSQWQELEHQALIYKYMVAGLPVPPDLVLPIQRSFESISHRFFHHPTM
SYCTFYGKKVDPEPGRCRRTDGKKWRCSKDAYPDSKYCERHMHRGRNRSRKPVESQTMTQSSSTVT
SLTVTGSSSGTGSFQNLPLHTYSNPQGTASGTNQSYYHMNSIPYGIPTKDYRYLQELTPEGGEHSF
LSEASGSNKGLQIDSQLDNAWSLMQSRVSSFPTEKSTENSMLQSNHPQHSFFSSDFTTRESVKQDG
QSLRPFFDEWPKNRDAWSGLENDSSNQTSFSTTQLSISIPMASSDFSTSCRSPRDN

SEQ ID NO: 73, Populus tremuloides Poptr_GRF_ lcl_scaff_XIV.174 nucleic acid sequence
GTCTGTTCTTGTTTTTGTAGATACACGACAATGGAGAAAAGAGTATCTGAAGAATCAGCGCCGTCG
ATGAAACTGTCTCTTGGGATTGGTGCTGGTGATCATGGTGATGATGATCAAGATGATAGACACGTG
TTCCCACAGTTAACAGAGACTCAGTTGCATGAGCTTAAACAGCAAGCTTTGATATTCAAGTACATA
GTAGCTGGTCTTCGCGTGCCTCCTGATCTTGTAGTTCCCATTTGGCATAGTGTTGCTAGCAGCTCT
CTTGGTTCATTTAGTGGTGCTGATATTTATAGGCAATTCCCAAGCTTTGTGGGATTAAGTCCTCAG
GGATTTGATTATAGACAAATGATGGATCCAGAACCTGGGAGATGTAGAAGAACTGATGGGAAGAAA
TGGAGGTGTAGCAAGGATGTAGTTGCTGGTCAGAAGTATTGTGAACGCCATATGCATAGAGGCCGT
CAACGTTCAAGAAAGCTTGTGGAAGCTTCTCAAACTGCTGCTGCTTCTGAAAAACCATCACCTCAC
AATTCAAGCAAGAATTCAGACAATCCAACCACTCATTCTTCTAATTTAGCCAAAGTAAGTTCACAG
ATAAAAGCCCCACCTCTTAATAATACCCCCACCATTTTAACCACTTGCACCACAAGTTGCAATTCT
GACATTGAAATCACTGGCATGAGCTTGGCCACTACTGCTAATTCTGACTGCAAAAACCCCTTTACA
ACCATGACTACTAGCATTGTTACCGGCTACAAGAACACTGCAACAATGATCGCTAGTGCTGTTCAT
GCTGACATTACAGCCACTGGTAACGACTACAAGAGTAGCATCAACTTAAAGAGACACTACATTGAT
GACAGAAACAGTAATTGCAGCAACTCTGTTACTTACAAGGGTATAATCGACAGAAACTGCAGCAAC
AAAAAAATAAAAAATGCTGGTAGCAATGTATCTCAAGGATTGAACTTCTCCCCGAAGAGTGTTCTT
CAAGTTCAAGGTTGCGGCGCCTCACACATTTACATGAATGATGTGGAACTTGAACTGGGAAGGTGT
AGAAGAACAGATGGAAAGAAGTGGCGATGCCGCAGGGATGTTGTAGCTAATCAGAAGTATTGCGAG
ATGCACATGCACCGAGGTTCTAAGCAGCACTTGGAAGCGTCCAAACCTGCTGCAATTCCCGCTACA
ATCCCATTTGTCCCTGGGAATGTTCATTCATATCCTGCAACGAACTTGCCAAGTAAAGCAGATCGC FIGURE 5 (continued)

AGAAGCTTAAACACCGATCTCTGTATTTCGATCCCAACAAGTCCTCAACTGATCATGACCAATGAT
GATACAAGAACTATCAGCAATAGCAGTGACACTACCATAAGCGACACCATGAGGGGCACCACACCA
GGACTGGTATCAACACATGCAGGTAGTGGGGATCCCAAAAGTCCTCCTGGTGGTGACAGAGCCAGG
TTATTAAAGAAAGCTGAAGTTATGGAGGCGGCGGTAGAGATTTACGAGGAAGTACAATCCGGCCGT
GGGGTCAGAAGTTTTATCCAAGGCAGAAGACTTCCAACTTTTCCCTATGTTTATATCACACCTCTG
CTGTTAATCTGCAATTAATTCTAGTCAAACCATGTGATTAAAGTTACAAGAGGTGTAAGAGAAGAA
TAACGTTTAATTCCATCCTATGCAGACAACTG

SEQ ID NO: 74, Populus tremuloides Poptr_GRF_ lcl_scaff_XIV.174 translated polypeptide sequence
MEKRVSEESAPSMKLSLGIGAGDHGDDDQDDRHVFPQLTETQLHELKQQALIFKYIVAGLRVPPDL
VVPIWHSVASSSLGSFSGADIYRQFPSFVGLSPQGFDYRQMMDPEPGRCRRTDGKKWRCSKDVVAG
QKYCERHMHRGRQRSRKLVEASQTAAASEKPSPHNSSKNSDNPTTHSSNLAKVSSQIKAPPLNNTP
TILTTCTTSCNSDIEITGMSLATTANSDCKNPFTTMTTSIVTGYKNTATMIASAVHADITATGNDY
KSSINLKRHYIDDRNSNCSNSVTYKGIIDRNCSNKKIKNAGSNVSQGLNFSPKSVLQVQGCGASHI
YMNDVELELGRCRRTDGKKWRCRRDVVANQKYCEMHMHRGSKQHLEASKPAAIPATIPFVPGNVHS
YPATNLPSKADRRSLNTDLCISIPTSPQLIMTNDDTRTISNSSDTTISDTMRGTTPGLVSTHAGSG
DPKSPPGGDRARLLKKAEVMEAAVEIYEEVQSGRGVRSFIQGRRLPTFPYVYITPLLLICN

SEQ ID NO: 75, Populus tremuloides Poptr_GRF_ lcl_scaff_XIV.51 nucleic acid sequence
AAGTAATAGTGGTTTTGCTTCTCTTGCTGGCTCAGATCCTGAAGCAAAGCAGAAGTTGTACGGATC
TGGGTTCTTGAAGCAAGAGAGACCTGGCAACATCGATGGTGATTGGAGGAGCTCTAAATTGTCGAA
AACTGAGTCAATGCTGCTTGAGCAGAGTAACACTTCACTTCTGAAATCTAGCTCCAACTTTCTCTT
CGCTGATGGACAGCAGCAGCAGCAGCAGATGCTCAGCTTCTCCTATCCCAGATCAGCTCCTTCAGC
GGAGAGAAGCTCCCAAAATGGCACATTGCCCTCTGGTATCTACAATGCTGCCAGCATGCATGGGGT
TTTGACCGAGACCAGATGGCCATTCACTCAATCACAATGGATGGAGCTTGAACATCAGGCCTTGAT
CTACAAGTATATAGCAGCAAATGTGCCTATACCATCTAATCTGCTCCTTCCCATTAGAAAAGCTCT
TGATTCTGCTGGGTTTCCTAGCTTTTCTGCTGGATTTTTCAGGCCCAATACATTGCCATGGGGTGC
TTTCCATATGGGTTTCTCCAGCAACACTGATCCGGAGCCAGGACGGTGTCGAAGGACAGATGGAAA
GAAATGGCGGTGCTCAAGAGATGCAGTTGCCGATCAGAAGTATTGTGAGCGGCATATGAACAGGGG
CCGCCATCGTTCAAGAAAGCCTGTGGAAGGCCAATCAGGCCATTCCGCTGCAGCCGCCACCACTGT
AAAGCCAGCCAATGGCACTTCGTCTTCTACATCATCATCAGTGGTGGGCTTCGCAGCACTGTGTC
CGACAGCCTCACTATTGCTCATAATCAGCAGCAAGCAGTAGTCCATCTAATCTTTCTGCCTCTAA
TACGCTCAGCAGGATGTTCCTTACTAAAGAGAATGTAGGTGAGAGAACGCAGGATGCGACAGCCTT
GTCCATGCTTCGATCCAACATGGATCTTAAATCTAAAGAAACTCCATTCTTCATATCAAAACAACA
AAACTCATATGGGGAATCCTTACGAAATGAGTTTGGACTTGTCACCTCCGACTCCCTCCTCAATCA
CTCACAGAAAAGCTCATCTTTAATGAGTTGCAGAAATTTTGGTTCGTCTCAGGACCTCACTGACCA
GGAATCTGTTTCACAGCACTCCCTCCGCCAATTCATGGATGATTGGCCTAAAAGTCAGTCTGATCG
TTCTGCTGTTTCTTGGCCTGAACTTGATCAGCAATCTGAGAGAACCCAGCTATCGATTTCAATCCC
CATGGCTCCTGCAGACTTCATGTCATCTACTTCCTCCCCAAACAATGAAAAGTCACTCTCTCCCC
ATTGAGATTATCACGAGAATTTGATCCAATACAGATGGGACTGGGAGTGGGAGGTGGAGGTGGTGG
TATTGCCAACGAACCAAACCAAAGGCAAGCCAACTGGATTCCCATTTCTTGGGGAACTTCAATGGG
TGGTCCGCTCGGGGAGGTCTTGCACAACACCAATAACAATGCAGCAGCAGAGTGCAAGACCACGTC
ATCGCTGAACCTGATGACCTATAGATGGGACAACAGTCCTCGTATAGGTTCATCTCCAACTGGGGT
CTTACAAAAGTCAGCGTTTGCTTCCCTTTCAAATAGCAGTGCGGGAAGCAGCCCAAGAGCAGAGAA
CAAGACCAATGAAGGTGGCAGTCTCTGCAATGACCTCCTTGGATCCACTATTGTGCATTCTTCTTC
ATTGCCTGCCATGTAACTCTGTTGATCTGCTGCCATCCAAGAAGTCTCCTGTCATCGTAGCTGACA
AAACATGGAGCACTTTGTTTTTGAAGTTGT

FIGURE 5 (continued)

SEQ ID NO: 76, Populus tremuloides Poptr_GRF_ lcl_scaff_XIV.51 translated polypeptide sequence
MLLEQSNTSLLKSSSNFLFADGQQQQQQMLSFSYPRSAPSAERSSQNGTLPSGIYNAASMHGVLTE
TRWPFTQSQWMELEHQALIYKYIAANVPIPSNLLLPIRKALDSAGFPSFSAGFFRPNTLPWGAFHM
GFSSNTDPEPGRCRRTDGKKWRCSRDAVADQKYCERHMNRGRHRSRKPVEGQSGHSAAAATTVKPA
NGTSSSTSSSVVGLRSTVSDSLTIAHNQQQAASPSNLSASNTLSRMFLTKENVGERTQDATALSML
RSNMDLKSKETPFFISKQQNSYGESLRNEFGLVTSDSLLNHSQKSSSLMSCRNFGSSQDLTDQESV
SQHSLRQFMDDWPKSQSDRSAVSWPELDQQSERTQLSISIPMAPADFMSSTSSPNNEKVTLSPLRL
SREFDPIQMGLGVGGGGGGIANEPNQRQANWIPISWGTSMGGPLGEVLHNTNNNAAAECKTTSSLN
LMTYRWDNSPRIGSSPTGVLQKSAFASLSNSSAGSSPRAENKTNEGGSLCNDLLGSTIVHSSSLPA
M

SEQ ID NO: 77, Populus tremuloides Poptr_GRF_ lcl_scaff_XIX.480 nucleic acid sequence
AGTGATGACCATGAGGTCGCCATTTACAGTATCGCAATGGCAAGAACTGGAACATCAAGCTTTGAT
CTATAAGTACATGGTGGCAGGTCTGCCTGTTCCTCCTGATCTTGTGCTCCCTATTCAGAGGAGTTT
TGAGTCCATTTCTCATAGATTCTTCCACCATCCCGCCATGGGCTATTGCACTTTCTATGGGAAGAA
GGTGGATCCGGAGCCAGGTCAATGCAGGAGGACCGACGGCAAGAAGTGGAGGTGCTCCAAAGATGC
ATACCCGGGCTCCAAGTACTGTGAGCGCCACATGCACCGTGGCCGCAACCGTTCAAGAAAGGCTGT
GGAATCACAAACCATGACACAGTCATCGTCCACTGTGACATCACTGACTGTAACAGGAAGCAGCAG
TGGAACAGGGAGCTTCCAGAACCTTCCACTGCGCACATATGGTAATCCCCAGGGCACTGGTTCTGG
ACCTAACCAATCCCATTATCATATGAACTGCATTCCCCGTGGAATCCCAACTAAAGATTGCAGGTA
TCTTCAAGGACTGAAGACTGAGGGTGGCGAGCATAGCTTCTTGTCTGAACCTTCAGGATGCAAAAG
GGGTCTCCAGAAGGACTCACAGCTAGACAATGCCTGGTCTTTGATGCTATCCAGAGGCTCATCATT
CCCCACAGAGAAATCGACTGACGACTCGACGTTGAAGAATGATTATCCCCAGCATTCATTTTTCAG
TAGTGATTTCACCACCGGAGAACCCGTGAAACACGAAGGGCAGTCTCTTCGACCCTTCTTTGACGA
GTGGCCTGAGGACCAGGACATTTGGTCTGGCCTCAAAGATAATAGATCCAACTCCACCTCATTCTC
TACAACGAAGCTGTCGATGTCCATTCCAATTGCCTCATCTGGCTTCTCCACAAGTTCTCGTTCTCC
ACAAGAAAACTGAGAGGACAGAATGAGAATTTACAAAGCACGATCAAAGGTGATCCTCAACCAAAG
ATTGGTGTGTTAACTTGAAAACTCCTA

SEQ ID NO: 78, Populus tremuloides Poptr_GRF_ lcl_scaff_XIX.480 translated polypeptide sequence
MTMRSPFTVSQWQELEHQALIYKYMVAGLPVPPDLVLPIQRSFESISHRFFHHPAMGYCTFYGKKV
DPEPGQCRRTDGKKWRCSKDAYPGSKYCERHMHRGRNRSRKAVESQTMTQSSSTVTSLTVTGSSSG
TGSFQNLPLRTYGNPQGTGSGPNQSHYHMNCIPRGIPTKDCRYLQGLKTEGGEHSFLSEPSGCKRG
LQKDSQLDNAWSLMLSRGSSFPTEKSTDDSTLKNDYPQHSFFSSDFTTGEPVKHEGQSLRPFFDEW
PEDQDIWSGLKDNRSNSTSFSTTKLSMSIPIASSGFSTSSRSPQEN

SEQ ID NO: 79, Populus tremuloides Poptr_GRF_ lcl_scaff_28.309 nucleic acid sequence
ACAACCCTCTGCAAAGATGCCAAAACTCCTCATGGATCCCCATCAACCACAACAACATCCACACTC
ATCTGGGTCTGCTGCCTTCCCTTTGTTTCTACCCGAGCCCAGCTGCAAAAATAGTAACCTGTCAGC
ATTTCCTGATTCAAACACAGCTGCAAACACCAGACTTCCTAAGATCATGGGGAATTACTTTAGCCT
GGAACAGTGGCAAGAGCTAGAGCTGCAGGCTTTGATCTACAGATTCATGTTAGCCGGTGCAGCTAT
TCCTCCGGAGCTCCTCCAACCAATCAAGAAAACCCTTCTTCATTCTCACCCCCCTCCATATTTCCT
CCATCATCCTCTTCAATTACATTGCTCTTATTATCAGCCATCTTGGTATTGGGGAAGAGCAGCCAT
GGATCCGGAGCCAGGTCGGTGCCGGAGAACAGATGGGAAGAAATGGCGGTGCTCCAGAGACGTGGT FIGURE 5 (continued)

```
GGCAGGGCACAAGTATTGCGAGCGCCACTTGCACCGTGGCCGCAACCGTTCAAGAAAGCCTGTGGA
AAATCCCACACCTACAATATCCACTAACATCACTTGCATTGGTATTGGAGGTGCGGGTGGTACCGC
ATCAGCTGCTGCTTTCAATTGCAGCACCACACCAACCATATCAGAGGTGGTCAATGAGACTCATTT
TTCGCATACACTAGAATCCCCTTCCATTCATCTCAATCATAGCTCCAAAACTGAAAGCAAGGGCTT
AATTGGACCACCACCTCCAAATGAGGTTGGTAACAGGTCTGATGGCCACATTCTGTGGCATTTTTT
TGATGACTGGCCACGATCCGTTGATGAATCCGACAATATGAATGCTGGAAGCTCAATGAACTCTTT
AACCTGCCTCTCCGTTTCAATGCCTGGAAACTCACCAGCATCAGATGTGTCATTGAAATTGTCCAC
TGGGAATAATATTGCAGAGGAGGAGCCGGAGCCAGTCCCAGCCCCGATCCCTAGAGGCAATACAAG
CAATTGGGCTGCTGCAGGATGGGGCACAAAAATTACAAACCAGGTGGTGACTTCAATGGGGGGACC
TCTTGCTGAGGCGCTGAGGTCCTCCACTACCAAACTCATCTCCCACGAATGTTCTGCACCAGTTAT
GTCGCCCCACTGTTTCTGAAACTTGATCTATTTTAGGTTAGTTTGTGGTGTAGTAACACATGCATG
CATACACACACACACACACACACACATCA
```

SEQ ID NO: 80, Populus tremuloides Poptr_GRF_ lcl_scaff_28.309 translated polypeptide sequence

```
MDFHLKQWRNQHEESGQQPSAKMPKLLMDPHQPQQHPHSSGSAAFPLFLPEPSCKNSNLSAFPDSN
TAANTRLPKIMGNYFSLEQWQELELQALIYRFMLAGAAIPPELLQPIKKTLLHSHPPPYFLHHPLQ
LHCSYYQPSWYWGRAAMDPEPGRCRRTDGKKWRCSRDVVAGHKYCERHLHRGRNRSRKPVENPTPT
ISTNITCIGIGELDQTTFSLFCFCFNLLAHPYCSSKTESKGLIGPPPPNEVGNRSDGHILWHFFDD
WPRSVDESDNMNAGSSMNSLTCLSVSMPGNSPASDVSLKLSTGNNIAEEEPEPVPAPIPRGNTSNW
AAAGWGTKITNQVVTSMGGPLAEALRSSTTKLISHECSAPVMSPHCF
```

SEQ ID NO: 81, Populus tremuloides Poptr_GRF_ lcl_scaff_I.688 nucleic acid sequence

```
GCGCTCGCTTGTGTTGTGGTGACAGGAGAAATGACACCATCTGTGAATGAGAGAGTGCTTTTTACA
GCTGCTCAGTGGCAAGAACTTGAAAGACAAACCACGATTTACAAGTACATGATGGCTTCTGTTCCT
GTCCCTCCTGAACTCCTTATACCCATCACCAAAAATCAATCAAATGTCCTTCCTCCACGGTCTAAC
AGTTCACTAGAACTGGGAATTCCTAGCCTGAACTCATCAGATGCAGAACCATGGAGATGCAAAAGA
ACTGATGGGAAAAAATGGAGGTGTTCAAGAGATGTGGCACCTGACCAGAAATACTGTGAGAGGCAC
TCTCATAAGAGCCGTCCCCGTTCAAGAAAGCCTGTGGAATTACACACTCATGACTCCCCGAGGACA
TTGACCAACAATAACACTAACACCAACAATAGCAATTACTCCACTAATCCACACCTGTTTAATCAA
AAACCTTACTTTCCAAGCCATTTATTTATGTTTCCTAGTGCCATGGCCCCTTCTGCCAGCTCATAT
GATCAACCCAGGAGCTTGGAATGGCTCTTGAAAGGCGAGATTTTACCCGTTGCCAGTAATTACAGC
CAAGAATGGCAGCATTTGAAGAGAGACAGCATCAAGGGTAATGGCAAAGTGTACAACGTTTATGGA
GAAGAGCAGCCGCTTTGCTCAAATACATATAGAGGTGGCCATTCATTACAAGCTCAGAGGCTAAAT
GATCATTGCAGCGTGTTATCAAGTCCCAAATCAACTACTTTGGAAAGGGCTTTAAGTCCTAGCCTG
ACCCAAGAACAAGAGACAAGGCACTTCATTGATGCTTGGTCAACTAATTCAGGGAGAGACGACATT
GGTGGGATTGGTAAAAAAAGTTACGTTTCTTCAAGTGAGAAGTTAGTATTGCCACATTCAGCTCTT
ACATTGTCAATGTCACCTGGCACTGGAAGTGAAACTAATAATGAAGGAAATGGGAGTGCTCAACTG
AGTAGTTTTGGGATCATGGGATTATCAGATAGAGATCATCAGAGTGCGAGTGGCTTGAGACCTCAG
TGGATGATGAGTCATGGTGGTTCATGGATAGTATCACCACCTGGTGGACCATTAGCTGAAGCCTTG
TGTCTTGGCATTTCCAGCAATGCAAAACTGCTTCCAATTTACCATCCCCTTGCAGCAGTAGCTGT
GGCCCCAATTAATGTCAACAAAAACCAACCGCTATAGTTTGTTGTAAATTCTGGCTGGGTAGAGGC
CAGAGGGTAGAAGCTAATGTGGCCCA
```

SEQ ID NO: 82, Populus tremuloides Poptr_GRF_ lcl_scaff_I.688 translated polypeptide sequence
MRSSWSRTRSGVFVDDIGLGLRMQDNLESCSGSSKRSVTAMSCDHEPAAHELSSSSCSGGGGGSGP
LFYSTSNHVTCLGDIKDVVASVSASGTGTPDAIAESKSLQYPYFISDSSPFTFNSSGEMTPSVNER
VLFTAAQWQELERQTTIYKYMMASVPVPPELLIPITKNQSNVLPPRSNSSLELGIPSLNSSDAEPW
RCKRTDGKKWRCSRDVAPDQKYCERHSHKSRPRSRKPVELHTHDSPRTLTNNNTNTNNSNYSTNPH
LFNQKPYFPSHLFMFPSAMAPSASSYDQPRSLEWLLKGEILPVASNYSQEWQHLKRDSIKGNGKVY
NVYGEEQPLCSNTYRGGHSLQAQRLNDHCSVLSSPKSTTLERALSPSLTQEQETRHFIDAWSTNSG
RDDIGGIGKKSYVSSSEKLVLPHSALTLSMSPGTGSETNNEGNGSAQLSSFGIMGLSDRDHQSASG
LRPQWMMSHGGSWIVSPPGGPLAEALCLGISSNAKTASNLPSPCSSSCGPN

SEQ ID NO: 83, Saccharum officinarum Sacof_GRF nucleic acid sequence contig of CA084837.1, CA238919.1, CA122516.1
CCAGCATCCACTCTCTCATCAGCAGCCTCTTCTTCTTCTCCCCCAAATGAGTGCTGAGTTTTGTGC
TGCTGCGGGCATGGAGCTCGGAGTCGGGGATGTGATGGGGCTGCAGCAAGGCATCGCCATCACCGC
GCCATCGCCCAGGGGCAGCGGCGACCTGGGTCTTCTCAAGCGAGCAGCCCTCACCCAGGCAGCAGC
TGGCCCCTACCCCTCCCCCTTCCTCGACGAACAGAAGATGCTCAGGTTCTCCAAGGCGGCTCACAC
ATTGCCCTCAGGGCTAGGCTTGGATTTTGGAGGCCCAAGCGAGCAGGCTTTCCTGCTGTCCAGGAC
CAAGAGGCCATTTACTCCCTCGCAGTGGATGGAGCTGGAGCACCAGGCTCTGATATACAAGTATCT
CAATGCAAAGGCCCCCATACCTTCCAGCCTGCTCATTTCAATCAGCAAGAGCTTCAGATCATCCAA
TAGAGTGAGCTGGAGGCCTCTCTATCAAGGCTACACAAATGCAGACTCTGACCCAGAGCCTGGAAG
ATGCCGACGAACAGATGGAAAGAAGTGGCGATGCTCCAAGGAGGCAATGGCTGATCACAAGTACTG
TGAGCGGCACATCAACAGAAACCGTCACCGTTCAAGAAAGCCTGTGGAAAACCAACCCAAAAAGAC
CACCAAGGAGGTGCCTGCTGCTGCTAGCTCATTGCCATGTGCTGGGCCACAAGGTTGCTTGAAGAA
GGCAAAAGTTAATGACTCCAAGCCAGGCACTGTCAGCTGTTGGACAGATAGTTTAAACAGGACAAT
GTTGAGCAGAGAGAAAGCAAACAAACCGACGGAGGACAACTCTTTGCTGCTTAATTCTACGAATAG
CCAGCCCACCTTGTCCCTGCTCTCTCAACTGAAGCAGCAGAACAAACCAGATAAGTTAGGTCCCAC
ACTGGAAAATGAGTCAAACTCAGACACAATACTGAAAGCCTGGGGTGGCAACCAGCCTAGCCACAA
GAGCATTTCCTCCACACAGCACCATGATGCTGAATCCCTCCAATCAGTCCTTCAAAATTTCAGCCT
AGCCCAGAATGAGAAGATGGAGTCAGAAAAGAACAAATATTCTGATTCCATGCTAGTTTCATCGAC
TTTCTATTCTGCAGACGGTCCACGATCTACCTGCCTTACACCTAACATGACACAAGTGCAGCAGGA
TTGCATATCAAGCTCTTGGGAGATGCCTCAAGGTGGACCTCTAGGCGAGATCTTAACCAACTCCAA
GAATAGTGAGGACTTAAGCAAGTGTGAATCAAGGTCATATGGTTGGTTATTGAATCTTGACCATGC
ACCATGATTCCTCAATCCATGGAGAGCTTGACATAGATGTCTCACCATGGAAGCAAACAATGGTCA
GAAAAGAAGGTTCAAATGACCACATTGTTTGCCCCATGCATGCTCGCTATCTACATTTGTATTTC
TGTTTTGTAGCATTTAGCTAGTTGAATTATCAGTTCTTCTGAATCTGGCTGTATTTTAAACAAATT
CTAGTTTGTGTCAGATGATATCTTGCTTGCTAGATGTTTCATGTCTAACTTTCAACAGGAACTTCA
GAGATCCATTTTGATCAACAGAAAACTGTTTGAAGAACC

SEQ ID NO: 84, Saccharum officinarum Sacof_GRF translated polypeptide sequence
MSAEFCAAAGMELGVGDVMGLQQGIAITAPSPRGSGDLGLLKRAALTQAAAGPYPSPFLDEQKMLR
FSKAAHTLPSGLGLDFGGPSEQAFLLSRTKRPFTPSQWMELEHQALIYKYLNAKAPIPSSLLISIS
KSFRSSNRVSWRPLYQGYTNADSDPEPGRCRRTDGKKWRCSKEAMADHKYCERHINRNRHRSRKPV
ENQPKKTTKEVPAAASSLPCAGPQGCLKKAKVNDSKPGTVSCWTDSLNRTMLSREKANKPTEDNSL
LLNSTNSQPTLSLLSQLKQQNKPDKLGPTLENESNSDTILKAWGGNQPSHKSISSTQHHDAESLQS
VLQNFSLAQNEKMESEKNKYSDSMLVSSTFYSADGPRSTCLTPNMTQVQQDCISSSWEMPQGGPLG
EILTNSKNSEDLSKCESRSYGWLLNLDHAP

FIGURE 5 (continued)

SEQ ID NO: 85, Vitis vinifera Vitvi_GRF nucleic acid sequence AM468035
ATGATGATGAGTGCAAGAAACAGGTCTCCTTTCACAGCATCACAGTGGCAAGAGCTTGAACATCAA
GCTCTTATCTTCAAATATATAGTGTCAGGAGTACCAATCCCAGCTGATCTCATCTGCACTGTCAAA
AGAAGCTTGGACTCTTCATTGTCTTCAAGGCTATTTCCTCACCAACCCATTGGGTGGGGTTGTTTT
CAGATGGGGTTTGGCAGGAAAGCAGACCCAGAGCCAGGGAGGTGCAGAAGAACTGATGGCAAGAAA
TGGAGGTGCTCCAAAGAAGCATACCCAGATTCAAAATACTGTGAGAGACACATGCACAGAGGCAAA
AACCGTTCAAGAAAGCCTGTGGAAGTTATTTCAGCTACAAACCCTTCACCAACCATCTCATCAATC
AACTCAAATCCTTCCTCCACCACCACCAATTCTTACTCTCTCTCCTCTCTCTCCTCTCTCTTCT
TCAATGACTTCTGAAACCTCCCATCCCCATCACCATTCCTACCACAACACCTCTCTTTATCCCTTC
CTCTACCCTCACCCCTCCTCTTCTAGACCTCCTGGTTCTTGCCTATCACCTCAAGCCACCAGCAGT
TACAGCACCCATCATCTGTTTTGGACTCTGGGTCTTATTCCCAGGCTGATAGGGATTACAGGGGT
GTGGATGAGAGAGCTTTCTTCCCAGAAGCTTCAGGGACTGTAAGGGGCCTACATGATTCATATACT
CCATTAACAATGAGTTCCTCCAAGGGATACTCTCACTTTCAGTATCAAAGCCCCGCTGATAATCCC
AAACAGCAGCAAGAACAGCAAGAGCAGCAGCACTGCTTTGTCTTGGGCACTGATTTCAAATCGTCA
AGGCCAATTAAAGTAGAGAGAGATGATGAAGCCCAGAAGCCTCTCCACCATTTCTTTGGAGAGTGG
CCTCTAAAGAACAGAGACTCCTGGCTTGACCTTGAGGAGGATCCACCAACCCATGCATCATTCTCC
ACCACCCAGCTCTCAATTTCAATCCCAATGTCCTCACACAAGCTTCTTGCATCGGATTCCAGAATC
CAAACTGGTACTTAGACTTCACTTCAGATTTGGCCTTCTTGCCCTTTATTTTCCCTTTTCTGCTAA
GTCTCATCTTCTACTTCATTTTTCCCCCTTGTGCAGATGGATGAGTTCTCAATACTGGTTCTTCTG
ATCATGGCCAAAAAGTACTTGTACTGGTGGGTTCAATGCTTTTCTTGTTGATTTTGTGACTGAAG
GAAGTTTCTTTTGCCAAATGTGCGGATGAATAATGTAGGGCCTATAGGAGGATTCTTGTCTTTGTG
CTTTCTGAGTTGCTAATTTTCATTCTTATCTTTAAAGAAACATGTTTGAATTTGTAGACTTGTTTG
TTTGACAGGAAGCATCTTGATATGGTTTTGAGTTTGAGTTTGAGTTGTTCTCTAATCTCTATGTT
GTTTTGTGAGTTGTGGCCACCTTTTCTTTTCCCTTTGGCTTCTGCTTATTGTACTTCAGAAAG

SEQ ID NO: 86, Vitis vinifera Vitvi_GRF translated polypeptide sequence
MMMSARNRSPFTASQWQELEHQALIFKYIVSGVPIPADLICTVKRSLDSSLSSRLFPHQPIGWGCF
QMGFGRKADPEPGRCRRTDGKKWRCSKEAYPDSKYCERHMHRGKNRSRKPVEVISATNPSPTISSI
NSNPSSTTTNSYSLSPLSPLSSSMTSETSHPHHHSYHNTSLYPFLYPHPSSSRPPGSCLSPQATSS
YSTHHLFLDSGSYSQADRDYRGVDERAFFPEASGTVRGLHDSYTPLTMSSSKGYSHFQYQSPADNP
KQQQEQQEQQHCFVLGTDFKSSRPIKVERDDEAQKPLHHFFGEWPLKNRDSWLDLEEDPPTHASFS
TTQLSISIPMSSHKLLASDSRIQTGT

SEQ ID NO: 87, Zea mays Zeama_GRF10_gi_146008494_gb_EF515849.1 nucleic acid sequence
AGAGCGCCGTATCACCTGTCTCTCCGTCCACCGCCGTCTCGATCCGCGCCAAAGATACCTTTCCCC
CACCCCTTCCTCGCGCCGCCGTTTGGTGCGACCATGACGGCGGAGGGGGAGGCCAAGAACCCGTCG
GCCGGTGGCGGAGGGGATAACCCCCAGCACCAGCAGGCTGCGCCGGCGCCGGCGCCGGCACAGGGG
GAAGTGGCGCAGGAGGCTGCAGTGCAGGGACGGGACAAGAGCAGGAGCGGGACAAGGCGGATCGA
GAGGTGCAGGGCGGCGCGGGGAGAAGGACGACGGCGCGTGCAGAGATCTGGTCCTGGTCGAGGAT
CCGGAGGTCCTCGCCGTCGAGGATCCGGAGGAAGCTGCAGCAACCGCAGCACTCCAGGAAGAAATG
AAAGCGCTTGTGGCATCGATCCCTGATGGTGCTGGAGCAGCATTCACAGCCATGCAGCTTCAGGAG
CTAGAGCAGCAGTCCCGGGTGTACCAGTACATGGCTGCCCGAGTACCTGTGCCTACTCACCTCGTC
TTCCCGGTATGGAAGAGTGTGACCGGTGCATCCTCTGAAGGCGCCCAGAAGTACCCTACTTTGATG
GGCTTAGCAACGCTCTGCTTGGACTTTGGGAAGAACCCGGAACCAGAACCAGGGAGGTGTCGGCGA
ACAGATGGTAAGAAATGGCGATGTTGGAGAAACACTATCCCAAACGAGAAATACTGCGAACGTCAC

```
ATGCATCGTGGCCGCAAGCGTCCTGTACAGGTTTTCCTGGAGGACGACGAGCCCGATTCTGCTTCA
GGGTCAAAACCCGCCGCTCCTGGCAAGGCTACCGAAGGTGCCAAGAAGGCCGATGACAAGAGCCCA
AGCAGCAAGAAGCTTGCAGTGGCAGCGCCTGCCGCTGTGCAGTCTACATAGTCAATTGCAGCTTTA
GTAGCCCGCAGAAGAGCATA
```

SEQ ID NO: 88, Zea mays Zeama_GRF10 translated polypeptide sequence
```
MTAEGEAKNPSAGGGGDNPQHQQAAPAPAPAQGEVAQEAAVQGTGQEQERDKADREVQGGAGEKDD
GACRDLVLVEDPEVLAVEDPEEAAATAALQEEMKALVASIPDGAGAAFTAMQLQELEQQSRVYQYM
AARVPVPTHLVFPVWKSVTGASSEGAQKYPTLMGLATLCLDFGKNPEPEPGRCRRTDGKKWRCWRN
TIPNEKYCERHMHRGRKRPVQVFLEDDEPDSASGSKPAAPGKATEGAKKADDKSPSSKKLAVAAPA
AVQST
```

SEQ ID NO: 89, Zea mays Zeama_GRF11 gi_146008515_gb_EF515850.1 nucleic acid sequence
```
GCCTCTGACACCAGCACAAACCTGGAGACTACTACTAGTATTGGAGTCCCCTCCACTTCCACCTCC
CTTGCCACTGAAGCGAGAGCTCTCGGAGCCGTCGTCCTCTGTCTCTCATCCTTCTTCGTTGTTGAG
CAAAGCGGGCTCGAGGAGGAGATGATGCTGAGCGGGCACGGCGGCGGGAGGCGCCTGTTCACGGCG
TCGCAGTGGCAGGAGCTGGAGCACCAGGCGCTCATCTTCAAATACATGGCCTCCGGCGCGCCCGTG
CCGCACGACCTCGTCCTGCCGCTCCGCCTCGCCACCGGCGTCGACACCGCGCCCTCCCTCGCCTTC
CCGCCCCAGCCTTCGCCGTCGCTGGCGTACTGGGGCTGCTATGGCGCGGGGCGCCGTTCGGCCGC
AAGGCGGAGGACCCGGAGCCCGGCGGTGCCGGCGGACGGACGGCAAGAAGTGGCGATGCTCCAGG
GAGGCCCACGGAGACTCCAAGTACTGCGAGAAGCACATCCACCGCGGGAAGAGCCGTTCAAGAAAG
CCTGTGGAAGTGACCTCCCCCGCCGCCTACCGCCCGTCCGCGTTCTCCATCTCGCCGCCTCGCGCG
GCCGACGCGCCGCCGCCGCCGCCGGGCCTCGGCCACCCGCAGCAGCAGCATCTCCGCCACGGCGCT
CTCTCTCCAGCAGGCCGCGCCCACGCCGCTGGCGCTCTCCAGCTCCACCTCGACTCGAGCCTGCAC
GCGGCGTCGCCGCCGCCGTCCTACCACAGGTACGCCCACTCCCACGCTCACTACACGCCGCCGCCG
CCGCCGTCGCTCTACGACTACGGGCAGTCCAAGGAGCTTCGGGAGGCGGCGGAGCTCAGGCGGCGG
CACTTCCACGCGCTCGGGGCCGACCTGAGCCTCGACAAGCCGCTGGCCGACGCCGGGGCCGCGGAG
AAGCCCCTGCGGCGTTTCTTCGACGAGTGGCCGCGGGAGAGAGGCGACACGAGGCCGTCGTGGGCG
GGGGCGGAGGACGCGACGCAGCTCTCCATCTCCATCCCCGCGGCTTCGCCCTCCTCTGACCACGCT
GCCTCTGCCGCCGCGCGATGCCACAACGATGGGAGTGATCGGTGCATCTCCTAGCTGCAACTGCAA
TGCAAGCCTGCAACCGCGTGGATTGTTGTTGATTGGTGTAGTTTCCTAGCTGCAATTCAAGCCTGC
AACAGCGAGCAGTGAGCAGCAAATGCGTGGGGAGGGCACGCAGCTCAGGCTGATGCGCAAAATCCG
AAGCGAGTCAAGCAGCAATAGGACTCTAGGTCTATGATTTGATCTTCCTTTGTAGCAGTACGTTAC
CAAAATGTTAGCTCGTTGTTGTTCGGTGTGACATTTTCGTTCAGGTTGCTCC
```

SEQ ID NO: 90, Zea mays Zeama_GRF11 translated polypeptide sequence
```
MMLSGHGGGRRLFTASQWQELEHQALIFKYMASGAPVPHDLVLPLRLATGVDTAPSLAFPPQPSPS
LAYWGCYGAGAPFGRKAEDPEPGRCRRTDGKKWRCSREAHGDSKYCEKHIHRGKSRSRKPVEVTSP
AAYRPSAFSISPPRAADAPPPPPGLGHPQQQHLRHGALSPAGRAHAAGALQLHLDSSLHAASPPPS
YHRYAHSHAYTPPPPPSLYDYGQSKELREAAELRRRHFHALGADLSLDKPLADAGAAEKPLRRFF
DEWPRERGDTRPSWAGAEDATQLSISIPAASPSSDHAASAAARCHNDGSDRCIS
```

FIGURE 5 (continued)

SEQ ID NO: 91, Zea mays Zeama_GRF12 gi_146008534_gb_EF515851.1 nucleic acid sequence
CGCATCCGTTCTCTATCGAAAGGGAGGAGGAGGAGCGCGCGGGAGTGGGCTGGGGGCCCACCGATG
CTGAGCTCGGCGTCCTCGGCCGGGGCGGCCATGGGGATGGGCGGCGGGTACCAACACCAGCCGCTG
CCACTGCCGCAGCGCGGGGCGGCGGCCGCGGTCTTCACCGCCGCGCAGTGGGCGGAGCTGGAGCAG
CAGGCGCTCATCTACAAGTACCTCATGGCCGGCGTCCCCGTCCCGCCCGATCTCCTCCGCCCCGCC
CCCCACGCCGCCGCCTTCTCCTTCGCCAGCCCCGCCGCGTCGCCCTTCTACCATCACCACCACCAC
CACCCGTCCCTGAGTTACTACGCCTACTACGGGAAGAAGCTGGACCCGGAGCCGTGGCGGTGCCGC
CGCACCGACGGCAAGAAGTGGCGGTGCTCCAAGGAGGCGCACCCCGACTCCAAGTACTGCGAGCGC
CACATGCACCGTGGCCGCAACCGTTCAAGAAAGCCTGTGGAATCCAAGACCGCCTCCTCGCCGCCC
CAGCTGTCCACCGTCGTCACCACCACCACCACCCGGGAGGCCGCCGCCGCGACGCCCCTCGAGTCC
CTCGCGGGGGCGGGGGGTAAGGCTCACGGCCTGTCCCTCGGCGGCGGGGCTGGCTCGTCGCACCTC
AGCGTCGACGCTTCGAACACTCACTTTCGCTATGGCAGCAAGTACCCTCTTGGAGCTAAATCCGAT
GCTGGCGAGCTGAGCTTCTTCTCAGGAGCACCAGGGAACTCCAGGGGCTTCACCATTGATTCTCCA
GCAGATAACTCTTGGCACTCCCTGCCATCCAACGTGCCCCCGTTTACACTGTCCAAGGGCAGAGAT
TCTGGCCTCCTGCCTGGAGCGCCACCAGTCGTCGTTCAGCAGCAGCGGGGCCGGCGCTGGTGGGTT
GCTGGGGAGCGTGAAGCAGGAGAACCAGCCGCTGAGGCCCTTCTTCGACGAGTGGCCTGGGACGCG
GGACTCGTGGTCGGAGATGGACGACGCGAGGTCCAGTAGGACCTCCTTCTCGACGACCCAGCTCTC
CATCTCCATTCCGATGCCCAGATGTGATTGAGAACGAAGCTCG

SEQ ID NO: 92, Zea mays Zeama_GRF12 translated polypeptide sequence
MLSSASSAGAAMGMGGGYQHQPLPLPQRGAAAAVFTAAQWAELEQQALIYKYLMAGVPVPPDLLRP
APHAAAFSFASPAASPFYHHHHHHPSLSYYAYYGKKLDPEPWRCRRTDGKKWRCSKEAHPDSKYCE
RHMHRGRNRSRKPVESKTASSPPQLSTVVTTTTTREAAAATPLESLAGAGGKAHGLSLGGGAGSSH
LSVDASNTHFRYGSKYPLGAKSDAGELSFFSGAPGNSRGFTIDSPADNSWHSLPSNVPPFTLSKGR
DSGLLPGAPPVVVQQQRGRRWWVAGEREAGEPAAEALLRRVAWDAGLVVGDGRREVQ

SEQ ID NO: 93, Zea mays Zeama_GRF13 gi_146008539_gb_EF515852.1 nucleic acid sequence
CCTCCCGTCAGCCTCTTCTTCTCCCCCTGATGAGCGCTGAGTTCTGTGCTGCCGCCGCTGGTGCTG
TGGCCATGGAGCTCGGAGTCGGGGATGTGATGGGGCTGCAGCAAGGCATCGCCGCCGCCACCGGGC
CATCGTCCGGAGACAGCGACCTGGGTCTTCTCAAGCGAGCAGGCCTCGCCCAGGCAGCCACCTCCT
ACCCCTCCCCTTTCCTCGACCAACAGAAGATGCTCAGGTTCTCCAAGGCGGCGGCGGCTCACACGT
CGCCCTCAGGCCTAGATTCGGAGGAGGCCCAAGCGAGCAGGCTTTCCTGCTGTCCAGGACCAAGC
GGCCGTTCACCCCGTCGCAGTGGATGGAGCTGGAGCACCAGGCTCTCATATACAAGTATCTCAATG
CCAAGGCCCCCATACCTTCCAGCCTGCTCGTTTCCATCAGCAAGAGCTTCAGGTCATCCAACAGAG
TGAGCTGGAGGCCTCTTTACCAAGGCTACGCAAACGCAGACTCCGACCCAGAACCTGGGAGGTGCC
GGCGGACAGACGGAAAGAAGTGGCGGTGCTCTAAGGAGGCGATGCCTGATCACAAGTACTGCGAGC
GCCACATCAATAGGAACCGCCACCGTTCAAGAAAGCCTGTGGAAAACCAACCTAGAAAGACCAGCA
AGGAGGTGCCTACCGCTGCTGCTGGCTCGTTGCCGTGTGCCGGGCACAAGGTAGCTTGAAGAAGG
CAAAAGTTAATGACTCCAAGCCAGGCACTGGCAGCTATTGGACAGATAGCTTAAACAGGACAATGC
TGAGCAGGGAGAAGGCAAACAAACCGACGGAAGACGAGTCTTTGCTGCTTAGTTCTACGAAGAACA
GCCAGCCCACCTTGTCCCTGCTCACTCAACTGAAGCAGCAGAACAAACCAGATAAGTTAGGTCCCA
CACCGGAAAATGAGCCGAACTCGGACACAATGTTGAAAGCCTGGGTGGCAGCCACCACAAGAACA
TTTCCTCCACACAGCGCCATGACGCTGAATCCTCCAATCAGTCCTCCAAAATTTCAGCCTAGCCC
AGAATGACAGGTTGGAGTCAGAAAAGAACAGATATTCTGATTCCGTGCTAGTCTCATCGGCTTTCT

FIGURE 5 (continued)

```
ATTCTGCAGACGGTCCACAAACTACCTGCCTTACACCTAACATGACACAAGTGCAGCAGGACTGCA
TATCAAGCTCCTGGGAGATGCCTCAAGGTGGACCTCTAGGCGAGATCTTAACGAACTCCAAGATTA
GTGAGGACTCAAGCAAGTGTGGATCTAGGTCATATGGTTGGCTATTGAATCTTGACCATGCACCAT
GATTCCTC
```

SEQ ID NO: 94, Zea mays Zeama_GRF13 translated polypeptide sequence
```
MSAEFCAAAAGAVAMELGVGDVMGLQQGIAAATGPSSGDSDLGLLKRAGLAQAATSYPSPFLDQQK
MLRFSKAAAAHTSPSGLDFGGGPSEQAFLLSRTKRPFTPSQWMELEHQALIYKYLNAKAPIPSSLL
VSISKSFRSSNRVSWRPLYQGYANADSDPEPGRCRRTDGKKWRCSKEAMPDHKYCERHINRNRHRS
RKPVENQPRKTSKEVPTAAAGSLPCAGPQGSLKKAKVNDSKPGTGSYWTDSLNRTMLSREKANKPT
EDESLLLSSTKNSQPTLSLLTQLKQQNKPDKLGPTPENEPNSDTMLKAWGGSHHKNISSTQRHDAE
SLQSVLQNFSLAQNDRLESEKNRYSDSVLVSSAFYSADGPQTTCLTPNMTQVQQDCISSSWEMPQG
GPLGEILTNSKISEDSSKCGSRSYGWLLNLDHAP
```

SEQ ID NO: 95, Zea mays Zeama_GRF14 gi_146008560_gb_EF515853.1 nucleic acid sequence
```
GCCACCAAGAGCCCTCCAACACACACCTGACCTCCCCTTCCCCCCTCTCTCCGCCGCCCGTTCCCC
GCGCCTCCGCCCGTACGTCCCGTTCCCGGTCGGCCGGCCGGTCCAAAGGGAGGGGAGGAGGAGGGG
CGCGGGAGTCGGGGCCCGCACCGATGCTGAGCTCGGCATCCTCGGCCGCGGGGCGGCCATGGGGA
TGGGCGGCGGCGGGTACGCGCACCAGCCCCCGCCACAGCGCGCGGTCTTCACCGCCGCGCAGTGGG
CGGAGCTGGAGCAGCAGGCGCTCATCTACAAGTACCTCATGGCCGGCGTCCCCGTCCCGCCCGACC
TCCTCCTCCCCGTCCGCCCCGGCCCCGCCGCCGCCTTCTCCTTCGCCGGCCCCGCCGCCGCGTCGC
CCTTCTACCACCAACACCACCCGTCCCTGAGCTACTACGCCTACTACGGCAAGAAGCTGGACCCGG
AGCCGTGGCGGTGCCGCCGCACCGACGGCAAGAAGTGGCGGTGCTCCAAGGAGGCGCACCCCGACT
CCAAGTACTGCGAGCGCCACATGCACCGTGGCCGCAACCGTTCAAGAAAGCCTGTGGAATCCAAGA
CCGCCTCGTCGTCGTCGCCCGCGCACCCGTCGCCGCCCCAGCTGTCCACCGTCACCACCACCGCGC
CTCTCGAGCCCCTTGCAGCGGCGGGGGGCAAGGTCCACGGCCTGTCCCTCGGCGGCGGCGCTGCTG
GCTCGTCGCACCTCGGCGTCGATGCTTCGAATGCTCACTATCGTTATGGTAGCAACAGGTACCCTC
TCGGAGCTAAACCGGACGGCGGCGAGTTGAGCTTCTTCTCAGGAGCGTCATCGGGGAACAACTCGA
GGGGTGGCTTCACCATCGACTCTCCATCAGATAACAACTCGTGGCACTCCGCCCTGGCGTCCAGCG
TGCCCCCGTTCACGCTGTCGACGAAGAGCGGGGACTCCGGCCTCCTGCCCGGCGCCTACGCCTCCT
ACTCCCAGTCCCACTCCCACATGGAGCCGCCGCGGGAGCTCGGGCAGGTCACCATCGCCTCGCTGG
CGCAGGAGCAGGAGCGCCAGCAGCCGTTCAGTGGTGGGATGCTCGGGAACGTGAAGCAGGAGAACC
AGAACCAGCCGCTGCGGCCCTTCTTCGACGAGTGGCCCGGGACGCGGGCGGACTCGTGGCCGCCGG
AGATGGACGGCGCGCCGCGGGCCGGCAGGACCTCCTTCTCCTCCTCCACCACCCAGCTCTCCATCT
CCATCCCGATGCCCAGATGTGAGCTGCATCTCAGAAACCAGAACTCTTAATTCTGTTCGCTGCCCG
AATCATGCTTGACCGAAACTTGTTTTCTGCAGGCGACTGACGAGGAACCGTCGATCGGGCGGCCAC
TAGACGGTGGACGCTCACGCTCACTAGTGCGCTGTCGCCTGGAGTGGAGATCGA
```

SEQ ID NO: 96, Zea mays Zeama_GRF14 translated polypeptide sequence
```
MLSSASSAAGAAMGMGGGGYAHQPPPQRAVFTAAQWAELEQQALIYKYLMAGVPVPPDLLLPVRPG
PAAAFSFAGPAAASPFYHQHHPSLSYYAYYGKKLDPEPWRCRRTDGKKWRCSKEAHPDSKYCERHM
HRGRNRSRKPVESKTASSSSPAHPSPPQLSTVTTTAPLEPLAAAGGKVHGLSLGGGAAGSSHLGVD
ASNAHYRYGSNRYPLGAKPDGGELSFFSGASSGNNSRGGFTIDSPSDNNSWHSALASSVPPFTLST
KSGDSGLLPGAYASYSQSHSHMEPPRELGQVTIASLAQEQERQQPFSGGMLGNVKQENQNQPLRPF
FDEWPGTRADSWPPEMDGAPRAGRTSFSSSTTQLSISIPMPRCELHLRNQNS
```

SEQ ID NO: 97, Zea mays Zeama_GRF1 gi_146008330_gb_EF515840.1 nucleic acid sequence
GACAGGTTGAGATGGCGATGCCGTATGCCTCTCTTTCCCCGGCAGGCGCCGCCGACCACCGCTCCT
CCACAGCCACGGCGTCCCTCGTCCCCTTCTGCCGCTCCACCCCGCTCTCCGCGGGCGGCGGGCTGG
GGGAGGAGGACGCCCAGGCGAGCGCGAGGTGGCCGGCCGCGAGGCCGGTGGTGCCGTTCACGCCGG
CGCAGTACCAGGAGCTGGAGCAGCAGGCGCTCATATACAAGTACCTGGTGGCCGGCGTGCCCGTTC
CGCCGGATCTCGTGGTTCCAATCCGCCGCGGCCTCGACTCCCTCGCTACCCGCTTCTACGGCCAAC
CCACACTCGGGTACGGACCGTACCTGGGGAGGAAACTGGATCCGGAGCCCGGCCGGTGCCGGCGAA
CGGACGGCAAGAAGTGGCGGTGCTCCAAGGAAGCCGCCCCGGACTCCAAGTACTGCGAGCGCCACA
TGCACCGCGGCCGCAACCGTTCAAGAAAGCCTGTGGAAACGCAGCTCGCGCCCCAGTCCCAACCGC
CGCCGCCGCGGCCGTCTCCGCCGCTCCGCCCTGGCAGCCGCCGCCGCCGCCGCCACCAACGGCA
GCGGCTTCCAGAACCACTCTCTCTACCCGGCCATCGCCGGCAGCACTGGTGGTGGAGGAGGAGTTG
GCGGGTCCGGCAATATCTCCTCCCCGTTCTCCTCGTCGATGGGGGATCGTCTCAGCTGCACATGG
ACAGTGTTGCCAGCTACTCCTACGCAGCTCTTGGTGGTGGAACTGCAAAGGATCTCAGGTACAACG
CTTACGGAATAAGATCTCTGGCGGACGAGCACAACCAGCTGATCGCAGAAGCCATCGACTCGTCGA
TAGAGAGCCAGAGGCGCCTCCCCAGCTCGTCGTTCCCGCTCTCGAGCTACCCACATCTCGGGGCGC
TGGGCGACCTGGGCGGCCAGAACAGCACGGTGAGCTCGCTGCCGAAGATGGAGAAGCAGCAGCCGC
CCTCGTCCTTCCTAGGGAACGACACCGGGGCCGGCATGGCCATGGGCTCCGCCTCCGCAAGCAGG
AGGGCCAGACGCTGCGGCACTTCTTCGACGAGTGGCCCAAGGCGCGGGACTCCTGGCCGGGCCTCT
CCGACGAGACCGCCAGCCTCGCCTCGTCCCCCCGGCGACCCAGCTGTCGATGTCCATACCCATGG
CGTCCTCCGACTTCTCCGTGGCCAGCTCCCAGTCGCCCAACGATGACTAATGGTGCGTGGATCGTC
GCGTTCTGGCCCTTTGTCTATCTCCCCTCCAGTCCTCCACCCACCGCGCAGTAGTAGCTGCGGAAA
CAGCCCATGCTCCTGTATATTTGTCGGTCATTTTCCGTGTCAGATCTGTGTACCAAACCAAGCGGC
GG

SEQ ID NO: 98, Zea mays Zeama_GRF1 translated polypeptide sequence
MAMPYASLSPAGAADHRSSTATASLVPFCRSTPLSAGGGLGEEDAQASARWPAARPVVPFTPAQYQ
ELEQQALIYKYLVAGVPVPPDLVVPIRRGLDSLATRFYGQPTLGYGPYLGRKLDPEPGRCRRTDGK
KWRCSKEAAPDSKYCERHMHRGRNRSRKPVETQLAPQSQPPAAAAVSAAPPLAAAAAAATNGSGFQ
NHSLYPAIAGSTGGGGVGGSGNISSPFSSSMGGSSQLHMDSVASYSYAALGGGTAKDLRYNAYGI
RSLADEHNQLIAEAIDSSIESQRRLPSSSFPLSSYPHLGALGDLGGQNSTVSSLPKMEKQQPPSSF
LGNDTGAGMAMGSASAKQEGQTLRHFFDEWPKARDSWPGLSDETASLASSPPATQLSMSIPMASSD
FSVASSQSPNDD

SEQ ID NO: 99, Zea mays Zeama_GRF2 gi_146008352_gb_EF515841.1 nucleic acid sequence
CCATCTGGCCATCTCCCCTTCCCCTGCTCCCCGAAGCAGCAAGCCAGCCTGCCCACCCGCAGCCA
TCACCTCCGCCGCTCTCCACCATGAATCCCATCCACCAGCACGACATCGTACCCAATCCTTCGTGA
CTGTTGCCTCCGCGCATCTCCGGGAGCAATGGAAGGAGGCCGAGATGTGTTCTTAGGTGCGGCGGC
AAGGGCGCCGCCGCCGCCGTCTTGCCCGTTTCACGGATCCGCTACCGCCACCCGCTCCGGTGG
AGCGCAGATGCTCAGCTTCTCCTCCAATGGCGTAGCAGGGTTGGGTCTGTGCTCAGGTGCCAGCAA
GATGCAGGGTGTGTTGTCGAGGGTGAGGAGGCCCTTCACTCCGACGCAGTGGATGGAGCTGGAGCA
CCAGGCCCTGATCTACAAGCACTTCGCTGTGAATGCCCCTGTGCCGTCCAGCTTGCTCCTCCCTAT
CAAAAGAAGCCTCAATCCATGGAGCAGCCTTGGCTCCAGCTCATTGGGATGGGCACCATTTCGTTC
CGGCTCTGCTGATGCAGAACCAGGAAGATGCCGCCGCACAGATGGCAAGAAGTGGCGGTGCTCTAG
AGATGCTGTCGGGGACCAAAAATACTGTGAGCGATACATAAAACGTGGTTGCCACCGTTCAAGAAA
GCATGTGGAAGGCCGAAAGGCAACACCGACCACTGCAGATCCAACCATGGCTGTTTCTGGTGGTTC
ATTGTTGCACAGCCATGCTGTTGCTTGGCAGCAGCAGGGCAAAGCTCAGCTGCTAATGTGACTGA

```
TCCATTCTCACTAGGGTCCAACAGGAATTTGCTGGATAAGCAGAATCTAGGTGACCAGTTCTCTGT
ATCCACTTCCATGGACTCCTTTGACTTCTCATCATCACATTCTTCCCCAAACCAAGCCAAAGTTGC
ATTTTCACCGGTGGCCATGCAGCACGAACATGATCAGCTGTATCTTGTGCATGGAGCCGGCAGCTC
AGCAGAAAACGTTAACAAGTCTCAGGATGGTCAGCTGCTAGTCTCGAGGGAAACAATTGACGACGG
ACCTCTGGGCGAGGTGTTCAAGGGCAAGAGTTGCCAGTCAGCATCCGCAGACATCTTAACTGACCA
TTGGACTTCGACTCGTGACTTGCGTCCTCCAACCGGAGTCCTACAAATGTCTAGCAGCAACACAGT
GCCAGCAGAGAATCACACGAGTAACAGTAGCTATCTCATGGCGAGGATGGCGAATTCTCAGACCGT
CCCAACACTCCACTGAGTGTTCATCAGGCTGGTCTTTGTTGGGACCACAAAATAACTGAAGCCATG
TTGATGTCCTGAGTTTGCTGATACAGTGATACTAGGTTTTCAGTCGAGTCTTGTAACTCCTGTTTT
AGAGTTGTTATATGTTCACGTCATGTTGCCTTTCATTTTCGGTTTCATTCAGATGGGTGTACTAAT
AATTTCTTTCCTTCTTACCTGTGAAGGATTTGAGTTCCAATCTGAGACGTGGGT
```

SEQ ID NO: 100, Zea mays Zeama_GRF2 translated polypeptide sequence
```
MEGGRDVFLGAAARAPPPPPSCPFHGSATATRSGGAQMLSFSSNGVAGLGLCSGASKMQGVLSRVR
RPFTPTQWMELEHQALIYKHFAVNAPVPSSLLLPIKRSLNPWSSLGSSSLGWAPFRSGSADAEPGR
CRRTDGKKWRCSRDAVGDQKYCERYIKRGCHRSRKHVEGRKATPTTADPTMAVSGGSLLHSHAVAW
QQQGKSSAANVTDPFSLGSNRNLLDKQNLGDQFSVSTSMDSFDFSSSHSSPNQAKVAFSPVAMQHE
HDQLYLVHGAGSSAENVNKSQDGQLLVSRETIDDGPLGEVFKGKSCQSASADILTDHWTSTRDLRP
PTGVLQMSSSNTVPAENHTSNSSYLMARMANSQTVPTLH
```

SEQ ID NO: 101, Zea mays Zeama_GRF3 gi_146008368_gb_EF515842.1 nucleic acid sequence
```
TAGCCGTGCTCCGCTCACCTTCTCTCGCGCTACAGTCTCAAGGGGTAGCTAGCCAAGCTACCAAGC
TCGTCAGGAACGAGAGAAAGAGGCCGGCGGTGCGCGGGGATGATGATGATGAGCAGCGGCCGGGCG
GGCGGCGGGGCCACCGCGGGGCGGTACCCGTTCACGGCGTCGCAGTGGCAGGAGCTGGAGCACCAG
GCGCTCATCTACAAGTGCCTGGCGTCCGGCAAGCCCATCCCTTCCTACCTCATGCCGCCGCTCCGC
CGCATCCTCGACTCCGCCCTCGCCACGTCGCCGTCCCTCGCCTACCCGCCGCAACCCTCGCTGGGC
TGGGGCTGCTTCGGGATGGGCTTCACCCGGAAGGCCGACGAGGACCCGGAGCCCGGGCGGTGCCGG
CGCACGGACGGCAAGAAGTGGCGCTGCTCCAAGGAGGCGTACCCGGACTCCAAGTACTGCGAGAAG
CACATGCACCGGGGCAAGAACCGTTCAAGAAAGCCTGTGGAAATGTCCTTGGCCACGCCGGCCCCG
GCGCCGGCCCCGCCGCCGCCACAACCGCCACCGCCACCTCATCCCCGGCGCCGTCCTACCACCGC
CCGGCCCACGACGCCACGCCGTCTCCGTACCACGCGCTGTATGGAGGCGGCGGCGGCGGCGGCGGT
AGCCCTTACTCGGCGTCGGCACGCCCAGGAGCAACCGGAGGCGGCGGCGCGTACCACCACGCGCAG
CATGTGAGCCCCTTCCACCTCCACCTCGAGACCACCCACCCGCACCCGCCGCCGCCCTACAACTAC
TCCGCCGACCAGAGGGACTACGCGTACGGGCACGCGGCCGCCAAGGAGGTCGGCGAGCACGCCTTC
TTCTCGGACGGCGCGGGCGAGCGGGTCGACCGCCAGGCCGCGGCGGGGCAGTGGCAGTTCAGGCAG
CTCGGGGTGGAGACGAAGCCGGGCCCCACGCCGCTGTTCCCCGTCGCCGGGTACGGGCACGGCGCG
GCGTCGCCGTACGGCGTCGAGCTGGGCAAGGACGACGACGAGCAGGAGGAGAGGCGCCGCCAGCAC
TGCTTCGTTCTTGGAGCCGACCTGCGGCTGGAGCGGCCGTCGTCGGGCCATGGCCATGGCCATGGC
CATGACCATGACGACGCCGCCGCCGCGCAGAAGCCGCTCCGGCCCTTCTTCGACGAGTGGCCGCAC
CAGAAGGGGGACAAGGCCGGGTCGTGGATGGGGCTCGACGGCGAGACGCAGCTCTCCATGTCCATC
CCCATGGCCGCTACCGACCTCCCCGTCACCTCCCGCTTCCGTAACGACGAGTGATGCCACATCAAA
CCTGGCGCTGGAAACTCGGAACGTATGGTG
```

SEQ ID NO: 102, Zea mays Zeama_GRF3 translated polypeptide sequence
MMMMSSGRAGGGATAGRYPFTASQWQELEHQALIYKCLASGKPIPSYLMPPLRRILDSALATSPSL
AYPPQPSLGWGCFGMGFTRKADEDPEPGRCRRTDGKKWRCSKEAYPDSKYCEKHMHRGKNRSRKPV
EMSLATPAPAPAPAAATTATATSSPAPSYHRPAHDATPSPYHALYGGGGGGGSPYSASARPGATG
GGGAYHHAQHVSPFHLHLETTHPHPPPPYNYSADQRDYAYGHAAAKEVGEHAFFSDGAGERVDRQA
AAGQWQFRQLGVETKPGPTPLFPVAGYGHGAASPYGVELGKDDDEQEERRRQHCFVLGADLRLERP
SSGHGHGHGHDHDDAAAAQKPLRPFFDEWPHQKGDKAGSWMGLDGETQLSMSIPMAATDLPVTSRF
RNDE SEQ ID NO: 103, Zea mays Zeama_GRF4 gi_146008393_gb_EF515843.1 nucleic acid sequence
TCCCTTCACCGCTGCCTCGACCCGCGCCGAAAGATACCTTTCCCCCCCTTCCTCTCGCGCCGCCGT
TTTGGTGCGACCATGGCGGCGGAGGGGAGGCCAAGAACCCGTCCGGCGGTGGCGAAGGGGGTAAC
CCCCAGCACCAGCAGGCAGTGCAGGCTGCGCCGGCGGAGCCGCCAATGGCACAGGGGAAGCGGTG
CAGGAGGCTGGAGCGCAGGCGACGGGACAAGAGCCGGAGGGGGAGAAGGCGAATCGAGATGGGGAG
GGAAGCGCGGGGGAGAAGGACGACGGCGCGTGCAGAGATCTGGTTCTGGTTGAGGATCCGGAGGTG
CTCGCCGTCGAGGACCCGGAGGAAGCTGCAGCAACCGCAGCACTCCAGGAAGAAATGAAAGCGCTC
GTGGCATCCGTCCCTGACGGTGCTGGGGCAGCATTCACAGCCATGCAGCTTCAGGAGCTAGAGCAG
CAGTCCCGGGTTTATCAGTACATGGCTGCCCGAGTACCTGTGCCTACTCACCTCGTCTTCCCCGTA
TGGAAGAGTGTAACCGGTGCATCCTCTGAAGGCGCCCAGAAGTACCCTACTTTGTTGGGCTTAGCA
ACACTCTGCTTGGACTTCGGGAAGAACCCTGAACCAGAACCAGGGAGGTGCCGGCGAACGGATGGC
AAAAAATGGCGATGTTGGAGAAACACTATTCCAAACGAGAAGTACTGCGAACGCCGCATGCATCGC
GGTCGCAAGCGTCCTGTACAGGTCGTCGAGGAAGCCGAGCCTGACTCTGCTTCAGGCTCAAAATCT
GCTCCCGGCAAGGCCACCGAAGGCGCCAAGAAGGTTGGCGACAAGAGCCCAGGTAGCAAGAAGCTT
GCCGTGGCGGCGGCAGCTGCAGCTGCTGCGCAGTCTACGTAATTGATGCAGCATTTTAGTAGTCGC
AGGAAGAGCATGGCGGCGCTGGCAACTAGCGCCTTCTTTTCATTGCATGTGATCTTTAGCTATAAC
CTCATTTAGCACACTCCCAGTGGTGTCCGTGGGAGGAG SEQ ID NO: 104, Zea mays Zeama_GRF4 translated polypeptide sequence
MAAEGEAKNPSGGGEGGNPQHQQAVQAAPAEPPMAQGEAVQEAGAQATGQEPEGEKANRDGEGSAG
EKDDGACRDLVLVEDPEVLAVEDPEEAAATAALQEEMKALVASVPDGAGAAFTAMQLQELEQQSRV
YQYMAARVPVPTHLVFPVWKSVTGASSEGAQKYPTLLGLATLCLDFGKNPEPEPGRCRRTDGKKWR
CWRNTIPNEKYCERRMHRGRKRPVQVVEEAEPDSASGSKSAPGKATEGAKKVGDKSPGSKKLAVAA
AAAAAQST SEQ ID NO: 105, Zea mays Zeama_GRF5 gi_146008412_gb_EF515844.1 nucleic acid sequence
CAGCCAGGTAAGGCAAAAGAGAGAGGGCGGAAGCAGCGGCAGAGCGGAGAGGGAGAGAGAAGAGCA
TATATGGGCATGGCGATGCCCTTTGCCTCCCCGTCTCCGGCAGCCGACCACCGCCCCTCCTCCCTC
CTCCCCTTCTGCCGCGCCGCCCCTCTCCGCGGCGGGAGAGGACGCCGCGCAGCAGCACGCGATG
AGCGGCAGGTGGGCCGCGAGGCCGGCGCTCTTCACGGCGGCGCAGTACGAGGAGCTGGAGCACCAG
GCGCTCATATACAAGTACCTCGTCGCCGGCGTGCCCGTCCCGCCGGACCTCCTCCTCCCCCTGCGC
CGAGGCTTCGTCTTCCACCAGCCACCCGCCCTTGGGTACGGCCCCTACTTCGGCAAGAAGGTGGAC
CCGGAGCCCGGCGGTGCCGGCGTACGGACGGCAAGAAGTGGCGGTGCTCCAAGGAGGCCGCCCCG
GACTCCAAGTACTGCGAGCGCCACATGCACCGCGGCCGCAACCGTTCAAGAAAGCCTGTGGAAGCG
CAGCTCGCGCCCCGCCGCACGCCCAGCCGCCGCAGCAGCAGCAGGCCCCGCGCCCGCTGCTGGC FIGURE 5 (continued)

```
TTCCAGAACCACTCGCTGTACCCGTCGATCCTCAACGGCAACGGCGGCGGCGGGTTAGGTGCTGGT
GCTGGTGGTGGCACGTTCGGCCTGGGGCCCACCTCTCAGCTGCACATGGACAGTGCCGCTGCCTAC
GCGACTGCTGCCGGTGGAGGGAGCAAATATCTCAGGTACTCTGCATACGGGGTGAAATCTCTGTCG
GACGAGCACAGCACGCTCTTGTCGGGCGGCATGGATCCGTCGATGATGGACAACTCGTGGCGCCTT
CTGCCATCCCAAAACAACACATTCCAAGCCACAAGCTACCCTGTGTTCGGCACGCTGAGTGGGCTA
GACGAGAGCACCATCGCGTCGCTGCCGAAGACCCAGAGGGAGCCCCTCTCTTTCTTCGGGAGCGAC
TTCGTGACCGCCGCCAAGCAGGAGAACCAGACGCTGCGCCCTTTCTTCGACGAGTGGCCCAAGTCG
AGGGACTCGTGGCCGGAGCTGGGCGAGGACGGCAGCCTCGGCTTCTCGGCCACCCAGCTCTCCATC
TCCATTCCCATGGCGACCTCCGACTTCTCCAACACCAGCTCCAGATCGCCGGGTGGAATACCGTCG
AGATGAACGAGTACCGTGCATGTGGATCCCAGCGTCTTAGGGTTGACGACTCTTCGGTGCTGGCCT
CATCGTATCATGCTCCTAAATTTTCGAACGATATATGCCTTATGTAACGCTATTTCTCTCATTGTT
ACAACACCCTTTACCCGTTTGGAATTGTGTTGAAGTGGATGGTCTGCGTTGCTC
```

SEQ ID NO: 106, Zea mays Zeama_GRF5 translated polypeptide sequence
```
MGMAMPFASPSPAADHRPSSLLPFCRAAPLSAAGEDAAQQHAMSGRWAARPALFTAAQYEELEHQA
LIYKYLVAGVPVPPDLLLPLRRGFVFHQPPALGYGPYFGKKVDPEPGRCRRTDGKKWRCSKEAAPD
SKYCERHMHRGRNRSRKPVEAQLAPPPHAQPPQQQQAPAPAAGFQNHSLYPSILNGNGGGLGAGA
GGGTFGLGPTSQLHMDSAAAYATAAGGGSKYLRYSAYGVKSLSDEHSTLLSGGMDPSMMDNSWRLL
PSQNNTFQATSYPVFGTLSGLDESTIASLPKTQREPLSFFGSDFVTAAKQENQTLRPFFDEWPKSR
DSWPELGEDSLGFSATQLSISIPMATSDFSNTSSRSPGGIPSR
```

SEQ ID NO: 107, Zea mays Zeama_GRF6 gi_146008429_gb_EF515845.1 nucleic acid sequence
```
GATATATGGCGATGCCCTTTGCCTCCCTGTCTCCGGCAGCCGACCACCGCCCCTCCTCCCTCCTCC
CCTACTGCCGCGCCGCCCCTCTCTCCGCGGTGGGAGAGGACGCCGCCGCGCAGGCGCAGCAGCAGC
AGCAGCAGCACGCTATGAGCGGCAGGTGGGCAGCGAGGCCGCCGGCGCTCTTCACAGCGGCGCAGT
ACGAGGAGCTGGAGCACCAGGCGCTCATATACAAGTACCTCGTCGCCGGCGTGCCCGTCCCGCCGG
ACCTCCTCCTCCCCCTACGCCGAGGCTTCGTCTACCACCAACCCGCCCTTGGGTACGGGCCCTACT
TCGGCAAGAAGGTGGACCCGGAGCCCGGCGGTGCCGGCGTACGGACGGCAAGAAGTGGCGGTGCT
CCAAGGAGGCCGCCCCGGACTCCAAGTACTGCGAGCGCCACATGCACCGCGGCCGCAACCGTTCAA
GAAAGCCTGTGGAAGCGCAGCTCGTGCCCCGCCGCACGCCCAGCCGCAGCAGCAGGCCCCCGCGC
CCACCGCTGGCTTCCAGAGCCACCCCATGTACCCATCCATCCTCGCCGGCAACGGCGGCGGCGGCG
GCGGGGTAGGTGGCGGTGCTGGCGGTGGCACGTTCGGCCTGGGCCCCACCTCTCAGCTGCGCATGG
ACAGTGCCGCTGCTTACGCGACTGCTGCTGATGGAGGGAGCAAAGATCTCAGGTACTCTGCCTACG
GGGTGAAGTCACTGTCGGACGAGCACAGCCAGCTCTTGCCCGGCGGCGGCGGCGGCATGGACGCGT
CAATGGACAACTCGTGGCGCCTGTTGCCGTCCCAAACCGCCGCCACGTTCCAAGCCACAAGCTACC
CTCTGTTCGGCGCGCTGAGCGGTCTGGACGAGAGCACCATCGCCTCGCTGCCCAAGACGCAGAGGG
AGCCCCTCTCCTTCTTCGGGAGCGACTTCGTGACCCCGAAGCAGGAGAACCAGACGCTGCGCCCT
TCTTCGACGAGTGGCCCAAGTCGAGGGACTCGTGGCCGGAGCTGAACGAGGACAACAGCCTCGGCT
CCTCGGCCACCCAGCTCTCCACCTCCATCCCCATGGCGCCCTCCGACTTCAACACCAGCTCCAGAT
CGCCGAATGGAATACCGTCAAGATGAACCTGAGTAACCATGCGGACCCCA
```

FIGURE 5 (continued)

SEQ ID NO: 108, Zea mays Zeama_GRF6 translated polypeptide sequence
MAMPFASLSPAADHRPSSLLPYCRAAPLSAVGEDAAAQAQQQQQQHAMSGRWAARPPALFTAAQYE
ELEHQALIYKYLVAGVPVPPDLLLPLRRGFVYHQPALGYGPYFGKKVDPEPGRCRRTDGKKWRCSK
EAAPDSKYCERHMHRGNRSRKPVEAQLVPPPHAQPQQQAPAPTAGFQSHPMYPSILAGNGGGGGG
VGGGAGGGTFGLGPTSQLRMDSAAAYATAADGGSKDLRYSAYGVKSLSDEHSQLLPGGGGGMDASM
DNSWRLLPSQTAATFQATSYPLFGALSGLDESTIASLPKTQREPLSFFGSDFVTPKQENQTLRPFF
DEWPKSRDSWPELNEDNSLGSSATQLSTSIPMAPSDFNTSSRSPNGIPSR

SEQ ID NO: 109, Zea mays Zeama_GRF7 gi_146008440_gb_EF515846.1 nucleic acid sequence
AGCGTGCATTGTTGAGCGAGTGCGGCCAAGCAACGCGGGCTCGAGGAGATGATGCTGAGCGGGCAC
GGCGGCGGGAGGCGCCTGTTCACGGCGTCGCAGTGGCAGGAGCTCGAGCACCAGGCGCTCATCTTC
AAGTACATGGCCTCGGGCGCGCCCGTGCCGCACGACCTCGTCCTACCGCTCCGCCTCGCCACCGGC
GTCGACACCGCGCCCTCCCTCGCCTTCCCGCCCCAGCCTTCGCCGTCGCTGGCGTACTGGGGCTGC
TACGGCGCGGGGGCGCCGTTCGTCGGCCGCAAGGCGGCGGAGGACACGGAGCCGGGGCGGTGCCGG
CGGACGGACGGCAAGAAGTGGCGGTGCTCCAGGGAGGCCCACGGCGACTCCAAGTACTGCGAGAAG
CACATTCACCGCGGGAAGAGCCGTTCAAGAAAGCCTGTGGAAGTGACCTCCTCCCCGCCGCCGGC
GCCGCTGCGGCGTACCGACCGTCCGCGATCTCCACCATCTCGCCGCCCCGCGCGGCCGACGCGCCG
CCGCCGAGCCTCGCCTACCCGCAGCAGCATCTCCTCCACGGCGCCTCCTCCTCCGCAGCAGCCCGC
GCCCCCGCTGGCGCTCTCCAGCTCCACCTCGACGCGAGCCTGCACGCGGCGGCGGCGTCGCCATCG
CCGCCGCCGTCCTACCACAGGTACGCCCACTACACACCGCCAGCGTCGTCGCTCTTCCCGGGCGGC
GGCTACGGCTACGACTACGACTACGGGCAGTCCAAGGAGCTCAGGCGACGGCACTTCCACGCGCTC
GGGGCCGACCTGAGCCTCGACAAGCCGCTGCCCGAGCCCGACACCGGCTCCGACGAGAAGCAGCCC
CTGCGGCGTTTCTTCGACGAGTGGCCGCGGGAGAGCGGCGACATGGCGGCGGACGACGCGACGCAG
CTTTCCATCTCCATCCCCGCGGCTTCGCCCTCCGACCTCGCTGCTACCTCCGCCTCCGCCGCCGCC
GCGCGATTCCACAACGGGGAGTGATCGGTCCATCTCCTAGCTGCAGCCCTGCAACAGCGTGGATTG
ACCGCTGCATTTCCTGGCTGCAATGCAAGCCTGCAACAGCGAGCAGTAAGCCAGTGACGTGGATGC
ATCTCGTAGCGGCAAACCCTGCTTCTGCCTCT

SEQ ID NO: 110, Zea mays Zeama_GRF7 translated polypeptide sequence
MMLSGHGGGRRLFTASQWQELEHQALIFKYMASGAPVPHDLVLPLRLATGVDTAPSLAFPPQPSPS
LAYWGCYGAGAPFVGRKAAEDTEPGRCRRTDGKKWRCSREAHGDSKYCEKHIHRGKSRSRKPVEVT
SSPAAGAAAAYRPSAISTISPPRAADAPPPSLAYPQQHLLHGASSSAAARAPAGALQLHLDASLHA
AAASPSPPPSYHRYAHYTPPASSLFPGGGYGYDYDYGQSKELRRRHFHALGADLSLDKPLPEPDTG
SDEKQPLRRFFDEWPRESGDMAADDATQLSISIPAASPSDLAATSASAAAARFHNGE

SEQ ID NO: 111, Zea mays Zeama_GRF8 gi_146008461_gb_EF515847.1 nucleic acid sequence
TTCGGCACGACCCAACAATGCACACCAACATCCACTCCCTCGTCAGGCTCCTCTCCCCCAAATGAG
CGCTGAGTTCTGCGCTGCTGCGGGTGTCGTGGCCATGGAGTCGGGGTCGGAGATGCGCTGGGGCT
GCAGCAAGGCATCGCAATCACCGCGCCATCGCCCAGGGACAGCGACCTGGGTCTTCTCAAGCGAGC
AGGCCTCACCCAGGCTGCGGCTGCTGCCCCTACCCCTCCCCTTCCTTGACGGGGAGAAGATGCT
CAGGTTCTCCAAGGCGGCTCACACATCGCACTCAGGCTTGGATTTTGGAGGCCCAGGTGAGCAGGC
TTTCCTGCTGTCCAGGACCAAGATGCCATTTACTCCCTCGCAGTGGATGGAGCTGGGGCACCAGGC
TCTGATATACAAGTACCTCAATGCAAAGGCCCCCATACCTTCCAGCCTGCTCATTTCAATCAGCAA
GAGCTTCAGATCATCCAATAGAGTGAGCTGGAGGCCTCTGTATCAAGGCTACACAAATGCAGACTC

```
TGACCCAGAACCTGGGAGATGCCGACGAACGGATGGAAAGAAGTGGCGGTGCTCCAAGGAAGCAAT
GGCTGATCACAAGTACTGTGAGCGGCACATCAACAGAAACCGTCACCGTTCAAGAAAGCCTGTGGA
AAATCAACCTAAGAAGACCACCAAGGAGGTGCCTGCTGCTGCTGGCTCATTACCATGTGCTGGGCC
ACAAGGTAGCTTGAAGAAGGCAAAAGTTAATGACTCCAAGCCAGGCACTGTCAGCTATTGGGCAGA
TAGTTTAAACAGGACAATGTTGAGCAGAGAGAAAGCAAACAAACCGACGGAAGATAGCTCTTTGCT
GCTTACTTCTACGAACAGCCAACCCACCTGGTCCCTGCTCTCTCAGCTGAAGCAGCAAAACAAACC
AGATAAGTTAGGCCCCACACTGGAAAATGAGTCAAACCCAGACACAATATTGAAAGCCTGGGGTGG
CAACCAGCCTAGCCACAAGAGCATTTCCTCTACAGAGCGCCATGATGCTGAATCCCTCCAATCAGT
CCTTCAAAATCTCAGCCTAGCCCAGAATGAGAAGATGGAGTCAGAAAAGGACAAATATTCTGATTC
CGTGCTAGTTTCGTCGACTTTCTATTCTGCAGGCGGTCCAAGAGCTACCTGCCTTACACCTAACAT
GACACAGGTGAAGCAGGATTGCATATCAAGCTCTTGGGAGATGCCTCAAGGTGGACCTCTAGGCGA
AATCTTAACGAACTCCAAGAATAGCAAGGACTTAAGCAAGTGCAAACCAAGGTCATATGGTTGGTT
GTTGAATCTTGACCATGCACCATGATTCCTCAATCCATGAAGAGCTTGACATAGATGTCCCATCAT
GTAGGCAAACAATGGTCAGAAAAGGTTATGACCACATTGCTTGCCCCATGCATGCTTGCTATCTA
CATTTGTATTTCTGTTGCGTAGCATTTAGCTAGTTGAATTATCAGTTCTTCTGGATACGGCTGT
```

SEQ ID NO: 112, Zea mays Zeama_GRF8 translated polypeptide sequence
```
MSAEFCAAAGVVAMELGVGDALGLQQGIAITAPSPRDSDLGLLKRAGLTQAAAAAPYPSPFLDGEK
MLRFSKAAHTSHSGLDFGGPGEQAFLLSRTKMPFTPSQWMELGHQALIYKYLNAKAPIPSSLLISI
SKSFRSSNRVSWRPLYQGYTNADSDPEPGRCRRTDGKKWRCSKEAMADHKYCERHINRNRHRSRKP
VENQPKKTTKEVPAAAGSLPCAGPQGSLKKAKVNDSKPGTVSYWADSLNRTMLSREKANKPTEDSS
LLLTSTNSQPTWSLLSQLKQQNKPDKLGPTLENESNPDTILKAWGGNQPSHKSISSTERHDAESLQ
SVLQNLSLAQNEKMESEKDKYSDSVLVSSTFYSAGGPRATCLTPNMTQVKQDCISSSWEMPQGGPL
GEILTNSKNSKDLSKCKPRSYGWLLNLDHAP
```

SEQ ID NO: 113, Zea mays Zeama_GRF9 gi_146008475_gb_EF515848.1 nucleic acid sequence
```
GTAGGTCGTTCGCAGGTAGGTAACCGTAACCTAGCTAGCTCGTCGGGATGATGATGATGAGCGGTC
GAGCGGCCACCGCGGGGCGGTACCCGTTCACGGCGTCGCAGTGGCAGGAGCTGGAGCACCAGGCGC
TCATCTACAAGTGCCTGGCGTCCGGCAAGCCCATCCCGTCCTACCTCATGCCACCGCTCCGCCGCA
TCCTCGACTCCGCCCTCGCCACGTCGCCGTCGCTCGCCGCCTTCCAGCCGCAACCCTCGCTGGGGT
GGGGGGGCTGCTTCGGGATGGGCTTCAGCAGGAAGCCCGCCGACGAGGACCCGGAGCCCGGGCGGT
GCCGGCGCACGGACGGCAAGAAGTGGCGCTGCTCCAAGGAGGCGTACCCGGACTCCAAGTACTGCG
AGAAGCACATGCACCGGGGCAAGAACCGTTCAAGAAAGCCTGTGGAAATGTCCTTGGCCACGCCGG
CGCCGCCGGCCTCCTCCGCTGCCACCACCTCGACGTCCCCGGCGCCGTCCTACCACCGCCCGGCCC
CCGCCGCGCACGACGCCGTGCCGTACCACGCGCCCTACGGCGCCGCGTACCATCACACGCAGACGC
AGGTGATGAGCCCCTTCCACCTCCACCTCGAGACCACCCACCCGCACCCGCCGCCGCCGCCGCCCT
ACTACTACGCGGACCAGAGGGACTACGCCTACGGCAAGGAGGTCGGCGAGCGCGCCTTCTTCTCCG
ACGGCGCGGGGGAGAGGGACCGCCAGCAGCAGGCCGCGGGGCAGTGGCAGTTCAAGCAGCTCGGGA
CGATGGAGGCGACGAAGCCGTGCCCCACCCCCACGCCGCTGCTCCCCGCCGCCGGGTACGGCGTCG
GTCAGGCCAAGGAAGACGAGGAGGAGGAAACGCGGCGGCAGCAGCAGCAGCACTGCTTCGTTCTTG
GCGCCGACCTGCGGCTGGCGAGCGGCCGTCGGGGGCACATGACGACGCCGCGCAGAAGCCGCTCC
GGCATTTCTTCGACGAGTGGCCGCACGAGAAGGGAGCAAGGCGGGTGGTGGATTGGGGACTCG
ACGGCGAGACGACGCAGCTCTCCATGTCCATCCCGATGGCGGCCGCTGCCGACCTCCCCGTCACCT
CCCGCTACCGTACGTGA
```

SEQ ID NO: 114, Zea mays Zeama_GRF9 translated polypeptide sequence
MMMMSGRAATAGRYPFTASQWQELEHQALIYKCLASGKPIPSYLMPPLRRILDSALATSPSLAAFQ
PQPSLGWGGCFGMGFSRKPADEDPEPGRCRRTDGKKWRCSKEAYPDSKYCEKHMHRGKNRSRKPVE
MSLATPAPPASSAATTSTSPAPSYHRPAPAAHDAVPYHAPYGAAYHHTQTQVMSPFHLHLETTHPH
PPPPPPYYYADQRDYAYGKEVGERAFFSDGAGERDRQQQAAGQWQFKQLGTMEATKPCPTPTPLLP
AAGYGVGQAKEDEEEETRRQQQQHCFVLGADLRLAERPSGAHDDAAQKPLRHFFDEWPHEKGSKAG
WWIGGLDGETTQLSMSIPMAAAADLPVTSRYRT

SEQ ID NO: 115, QLQ domain
RPPFTPTQWEELEHQALIYKYMVSGVPVPPELIFSIRRS

SEQ ID NO: 116, WRC domain
DPEPGRCRRTDGKKWRCSREAYPDSKYCEKHMHRGRNRARKSLD

SEQ ID NO: 117, Oryza sativa GOS2 promoter
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTTCTCCCATCTATAA
ATTCCTCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAAGGGGATCTGTATCTGTGATGATTCC
TGTTCTTGGATTTGGGATAGAGGGGTTCTTGATGTTGCATGTTATCGGTTCGGTTTGATTAGTAGT
ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA
AACAGTTATAATCCTCAGGAACAGGGGATTCCCTGTTCTTCCGATTTGCTTTAGTCCCAGAATTTT
TTTTCCCAAATATCTTAAAAAGTCACTTTCTGGTTCAGTTCAATGAATTGATTGCTACAAATAATG
CTTTTATAGCGTTATCCTAGCTGTAGTTCAGTTAATAGGTAATACCCCTATAGTTTAGTCAGGAGA
AGAACTTATCCGATTTCTGATCTCCATTTTTAATTATATGAAATGAACTGTAGCATAAGCAGTATT
CATTTGGATTATTTTTTTATTAGCTCTCACCCCTTCATTATTCTGAGCTGAAAGTCTGGCATGAA
CTGTCCTCAATTTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTC

SEQ ID NO: 118, prm10010
GGGGACAAGTTTGTACAAAAAAGCAGGCTTAAACAATGATGAGTCTAAGTGGAAGTAG

SEQ ID NO: 119, prm10011
GGGGACCACTTTGTACAAGAAAGCTGGGTAGCTCTACTTAATTAGCTACCAG FIGURE 5 (continued)

MSGVWVFKNGVVRLVEKQQATAGTAVAGGRRKALVHTPSGQVVS
   ‾‾‾‾‾
     1

SYAALEARLTALGWERYYEDPSLFQFHKRGSLDLISLPADFSAF
           ‾‾‾‾‾‾‾                ‾‾‾‾‾‾‾‾‾
              2                        3

SSVHMYDIVVKNRDSFRVVDA
   ‾‾‾‾‾‾‾‾‾‾
       4

FIGURE 6

| | |
|---|---|
| gi\|115446015\|ref\|NP_001046787. | ---------------------------------------------------- |
| gi\|115457536\|ref\|NP_001052368. | ---------------------------------------------------- |
| gi\|40949983\|gb\|AAR97604.1\| | ---------------------------------------------------- |
| gi\|115435746\|ref\|NP_001042631. | ---------------------------------------------------- |
| gi\|115442049\|ref\|NP_001045304. | ---------------------------------------------------- |
| gi\|42573333\|ref\|NP_974763.1\| | ---------------------------------------------------- |
| gi\|15238633\|ref\|NP_197868.1\| | MIIYLSVYTPLYQHIYIYIAHTLHGFLILIKINKLIFEYPKKNLASSNFF 50 |
| gi\|79492649\|ref\|NP_194866.2\| | ---------------------------------------------------- |
| gi\|147846612\|emb\|CAN81644.1\| | ---------------------------------------------------- |
| gi\|115473993\|ref\|NP_001060595. | ---------------------------------------------------- |
| gi\|115452981\|ref\|NP_001050091. | ---------------------------------------------------- |

| | |
|---|---|
| gi\|115446015\|ref\|NP_001046787. | ----------MAGVWVFK-DGIVRRVENPGSEESSSAGDGGGGR--------R 35 |
| gi\|115457536\|ref\|NP_001052368. | ----------MAGVWVFE-DGMVRRADSEAPSRGRGVGGGGGG---------- 33 |
| gi\|40949983\|gb\|AAR97604.1\| | ----------MSGVWVFK-NGVVRLEDCQGSSGRR----------------- 24 |
| gi\|115435746\|ref\|NP_001042631. | ----------MSGVWVFK-NGVVRLVEKQ-QATAGTAVAGG---------RR 31 |
| gi\|115442049\|ref\|NP_001045304. | ----------MSGVWVFR-NGVVKLVENP-PASANSGGGGGGGGGGGGIRR- 41 |
| gi\|42573333\|ref\|NP_974763.1\| | ----------MSGVWVFN-NGVIRLVENP-NQSGGVSTQSHG--------RR 32 |
| gi\|15238633\|ref\|NP_197868.1\| | ----------MSGVWVFK-NGVIRLVENP-NQSG---SDTQN--------RR 29 |
| gi\|79492649\|ref\|NP_194866.2\| | KYIITSTMSGVWVFNKNGVMRLVENPYNQSAGDSSESSSGGNQQRMRR---- 100 |
| gi\|147846612\|emb\|CAN81644.1\| | ----------MSGVWVFDKNGVARLVTNPTRESFEQKEPPFPGTATAPG-ARP 42 |
| gi\|115473993\|ref\|NP_001060595. | ----------MAGGGVWVFRNNGVMELEEQA-----------------TSR- 24 |
| gi\|115452981\|ref\|NP_001050091. | ---------------------------------------------------- |

FIGURE 7

```
gi|115446015|ref|NP_0010467787.    KVLVHVPSGEVVASYEVLERRLRELGWERYLTD------------PCLLQFHQR 77
gi|115457536|ref|NP_0010523368.    KVLVHVPSSEVVTSYEVLERRLRELGWERYLND------------PCLLQFHQR 75
gi|40949983|gb|AAR97604.1|         KVLVHVPSNEVITSYAVLERKLHSLGWERYDD-------------LDLLQYHKR 66
gi|115435746|ref|NP_0010042631.    KALVHTPSGQVVSSYAALEARLTALGWERYED-------------PSLFQFHKR 73
gi|115442049|ref|NP_0010045304.    KALLHMPTGEVVTSYASLERKLAALGWERYYSGGGGAAAAAMLQFHKR 91
gi|42573333|ref|NP_974763.1|       NVLVYLPTGEAVSSYSSLEQILRSLGWERYFSG-------------DSDLIQYHKR 75
gi|15238633|ref|NP_197868.1|       KVMVYLPTGEVVSSYSTLEQILQSLGWERYFGGG------------DTDLLQFHKR 73
gi|79492649|ref|NP_194866.21       KILVHLPSSEVVSSYGSLEKILKNLGWERYSGDN-----TDHLLQFHKR 145
gi|147846612|emb|CAN81644.1|       RLLVYLPENQVIRSYTELEQRLNQLGWSRYHNYQH----------PSLVQFHKS 86
gi|115473993|ref|NP_0010060595.    KALVHVATSEVIRSTEALERRLGALGWERYED-------------RATLQLHRR 66
gi|115452981|ref|NP_0010050091.    -------MGSLQALERRLAGLGWERYED-----------------RAVVQLHRR 31
                                              *    **  *  *  ****  **      *    *:

gi|115446015|ref|NP_0010467787.    -STVHLISVPRDFSKFKLVHMYDIVVKTRNVFEVRDAAAPAVSPAT---- 122
gi|115457536|ref|NP_0010523368.    -STVHLISVPRDFSRLKLVHMYDVVVKTRNVFEVRDAATTASPP----- 118
gi|40949983|gb|AAR97604.1|         -STVHLISLPKDFNKLKPMHMYDIVVKNRNEFEVRDI------------ 102
gi|115435746|ref|NP_0010042631.    -GSLDLISLPADFSAFSSVHMYDIVVKNRDSFRVVDA------------ 109
gi|115442049|ref|NP_0010045304.    -SSVDLISLPKDFSQFGSVHMYDIVVKNRDAFRVIDV------------ 127
gi|42573333|ref|NP_974763.1|       -SSIDLISLPRDFSKFNSVYMYDIVVKNPNSFHVRDFN----------- 112
gi|15238633|ref|NP_197868.1|       -SSIDLISLPRDFTKFNSVYMYDIVVKNPNYFHVRDSH----------- 110
gi|79492649|ref|NP_194866.21       -TSIDLISLPRDFSKFNSIHMYDIVVKNPNVFHVRDM------------ 181
gi|147846612|emb|CAN81644.1|       DNSSHLLSLPKSFANFKSFHFYDIVKNRSFFEVREA------------- 123
gi|115473993|ref|NP_0010060595.    DGSADLISIPRDFSRFRSTHMYDVVVKNRDHFKVDVMEKN--------- 106
gi|115452981|ref|NP_0010050091.    DGGADLISLPRDFARFRSTHMYDVVLKNRDHFKGGSAEERAWLRRLSATS 81
                                        *:**: *. * .:* :::**:*::*.     :
```

FIGURE 7 (continued)

```
gi|115446015|ref|NP_001046787.1|    ----------------------------------------
gi|115457536|ref|NP_001052368.1|    ----------------------------------------
gi|40949983|gb|AAR97604.1|          ----------------------------------------
gi|115435746|ref|NP_001042631.1|    ----------------------------------------
gi|115442049|ref|NP_001045304.1|    ----------------------------------------
gi|42573333|ref|NP_974763.1|        ----------------------------------------
gi|15238633|ref|NP_197868.1|        ----------------------------------------
gi|79492649|ref|NP_194866.2|        ----------------------------------------
gi|147846612|emb|CAN81644.1|        ----------------------------------------
gi|115473993|ref|NP_001060595.1|    ----------------------------------------
gi|115452981|ref|NP_001050091.1|    TAAGGGPGCGGAKDRSGSRW    101
```

FIGURE 7 (continued)

SEQ ID NO: 120, NM_001049166.1 Oryza sativa (japonica cultivar-group) Os01g0257300 (Os01g0257300) RAA1-like mRNA, complete cds
TCCATCCACCCATAGCTATCTCTAGCTAGCTTGCACATTCTTCATTCTTCTTGCAATCAGAGCTAG
AGAAAAAGAGTTTGAGAGAGATCTAAGAGATGTCAGGGGTTTGGGTGTTCAAGAACGGGGTGGTGA
GATTGGTGGAGAAGCAGCAGGCGACGGCGGGGACGGCGGTGGCGGGAGGGAGGAGGAAGGCGCTGG
TGCACACGCCGAGCGGGCAGGTGGTGTCGTCGTACGCGGCGCTGGAGGCGCGGCTGACGGCGCTCG
GGTGGGAGCGCTACTACGAGGACCCCTCCCTCTTCCAGTTCCACAAGCGTGGCTCCCTCGACCTCA
TCTCCCTCCCCGCCGACTTCTCCGCCTTCTCCTCCGTCCACATGTACGACATCGTCGTCAAGAACC
GCGACTCCTTCCGCGTCGTCGACGCCTAAATTGACCTATGTATAGGCTCGCATGCATGCAAGGTAG
ACGACCATCCACCTTGCATGCATGCAGGCTATCATTCTCTCTTCGTCTCCGTCTTCGTCTTTCATC
TTTGTTGTGGTGTGTGTGAATTTATTATACTTCTTATGACTGTGTGTGTGACTGTGTGAGAGTTCA
TGGAGAGTGATGAGTAGTGGTATACATATGTGTCGTCGCTGATCGATTTGGTTTATTACCTTGTGG
GTGGGTATTAATTATCAGCAGTGTGTTATATCAATTGCTTACTTGTATGTGTATCATGTACATGAG
TGAGTGTGGCTGATGCATATATATAGAGGTCTTTAATAATTATGTACTATATATTTGTG

SEQ ID NO: 121, Q9LGE3_ORYSJ_FPF1 protein-like (Putative uncharacterized protein) (Os01g0257300 protein) (RAA1). [Oryza sativa subsp. japonica]
MSGVWVFKNGVVRLVEKQQATAGTAVAGGRRKALVHTPSGQVVSSYAALEARLTALGWERYYEDPS
LFQFHKRGSLDLISLPADFSAFSSVHMYDIVVKNRDSFRVVDA

SEQ ID NO: 122, prm09129 (attB1)
GGGGACAAGTTTGTACAAAAAAGCAGGCTTAAACAATGTCAGGGGTTTGGGTG

SEQ ID NO: 123, prm09988 (attB2)
GGGGACCACTTTGTACAAGAAAGCTGGGTTGTCGCATAGGTCAATTTAGG

SEQ ID NO: 124, PRO0129
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTTCTCCCATCTATAA
ATTCCTCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAAGGGGATCTGTATCTGTGATGATTCC
TGTTCTTGGATTTGGGATAGAGGGGTTCTTGATGTTGCATGTTATCGGTTCGGTTTGATTAGTAGT

FIGURE 10

ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA
AACAGTTATAATCCTCAGGAACAGGGGATTCCCTGTTCTTCCGATTTGCTTTAGTCCCAGAATTTT
TTTTCCCAAATATCTTAAAAAGTCACTTTCTGGTTCAGTTCAATGAATTGATTGCTACAAATAATG
CTTTTATAGCGTTATCCTAGCTGTAGTTCAGTTAATAGGTAATACCCCTATAGTTTAGTCAGGAGA
AGAACTTATCCGATTTCTGATCTCCATTTTTAATTATATGAAATGAACTGTAGCATAAGCAGTATT
CATTTGGATTATTTTTTTATTAGCTCTCACCCCTTCATTATTCTGAGCTGAAAGTCTGGCATGAA
CTGTCCTCAATTTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTC

SEQ ID NO: 125, PRO0170
CATGCGGCTAATGTAGATGCTCACTGCGCTAGTAGTAAGGTACTCCAGTACATTATGGAATATACA
AAGCTGTAATACTCGTATCAGCAAGAGAGAGGCACACAAGTTGTAGCAGTAGCACAGGATTAGAAA
AACGGGACGACAAATAGTAATGGAAAAACAAAAAAAAACAAGGAAACACATGGCAATATAAATGGA
GAAATCACAAGAGGAACAGAATCCGGGCAATACGCTGCGAAAGTACTCGTACGTAAAAAAAAGAGG
CGCATTCATGTGTGGACAGCGTGCAGCAGAAGCAGGGATTTGAAACCACTCAAATCCACCACTGCA
AACCTTCAAACGAGGCCATGGTTTGAAGCATAGAAAGCACAGGTAAGAAGCACAACGCCCTCGCTC
TCCACCCTCCCACCCAATCGCGACGCACCTCGCGGATCGGTGACGTGGCCTCGCCCCCAAAAATA
TCCCGCGGCGTGAAGCTGACACCCCGGGCCCACCCACCTGTCACGTTGGCACATGTTGGTTATGGT
TCCCGGCCGCACCAAAATATCAACGCGGCGCGGCCCAAAATTTCCAAAATCCCGCCCAAGCCCCTG
GCGCGTGCCGCTCTTCCACCCAGGTCCCTCTCGTAATCCATAATGGCGTGTGTACCCTCGGCTGGT
TGTACGTGGCGGGTTACCCTGGGGGTGTGGGTGGATGACGGGTGGGCCCGGAGGAGGTCCGGCCC
CGCGCGTCATCGCGGGGCGGGGTGTAGCGGGTGCGAAAAGGAGGCGATCGGTACGAAAATTCAAAT
TAGGAGGTGGGGGGCGGGGCCCTTGGAGAATAAGCGGAATCGCAGATATGCCCCTGACTTGGCTTG
GCTCCTCTTCTTCTTATCCCTTGTCCTCGCAACCCCGCTTCCTTCTCTCCTCTCCTCTTCTCTTCT
CTTCTCTGGTGGTGTGGGTGTGTCCCTGTCTCCCCTCTCCTTCCTCCTCTCCTTTCCCCTCCTCTC
TTCCCCCCTCTCACAAGAGAGAGAGCGCCAGACTCTCCCCAGGTGAGGTGAGACCAGTCTTTTTGC
TCGATTCGACGCGCCTTTCACGCCGCCTCGCGCGGATCTGACCGCTTCCCTCGGCCTTCTCGCAGG
ATTCAGCC

SEQ ID NO:126, NM_001067130.1 Oryza sativa (japonica cultivar-group) Os07g0671000 (Os07g0671000) mRNA, complete cds
ATGGCGGAGGAGGGGTGTGGGTGTTCAGGAACAACGGGGTGATGGAGCTGGAGGAGCAGGCGACG
AGCAGGAAGGCGCTGGTGCATGTGGCGACGAGCGAGGTGATCCGGTCGACGGAGGCGCTGGAGCGG
AGGCTGGGGGCGCTGGGGTGGGAGCGCTACTACGAGGACCGCGCCACCCTGCAGCTCCACAGGCGC
GACGGCAGCGCCGACCTCATCTCCATCCCCCGCGACTTCTCCCGCTTCCGCTCCACCCACATGTAC
GACGTCGTCGTCAAGAACCGCGACCACTTCAAGGTTGATGTGATGGAAAAGAACTGA

SEQ ID NO: 127, Q8H475_ORYSJ_Putative uncharacterized protein P0470D12.115 (Os07g0671000 protein). [Oryza sativa subsp. japonica]
MAGGGVWVFRNNGVMELEEQATSRKALVHVATSEVIRSTEALERRLGALGWERYYEDRATLQLHRR
DGSADLISIPRDFSRFRSTHMYDVVVKNRDHFKVDVMEKN

FIGURE 10 (continued)

SEQ ID NO: 128, CM000144.1:27283532..27283849, OsJ_024523, hypothetical protein, similar to RNA sequence, EST similar to Arabidopsis
ATGGCGGGAGGAGGGGTGTGGGTGTTCAGGAACAACGGGGTGATGGAGCTGGAGGAGCAGGCGACG
AGCAGGAAGGCGCTGGTGCATGTGGCGACGAGCGAGGTGATCCGGTCGACGGAGGCGCTGGAGCGG
AGGCTGGGGGCGCTGGGGTGGGAGCGCTACTACGAGGACCGCGCCACCCTGCAGCTCCACAGGCGC
GACGGCAGCGCCGACCTCATCTCCATCCCCCGCGACTTCTCCCGCTTCCGCTCCACCCACATGTAC
GACGTCGTCGTCAAGAACCGCGACCACTTCAAGGTCGTCGACCTCCACACCTAG SEQ ID NO: 129, A3BNA1_ORYSJ_Putative uncharacterized protein. [Oryza sativa subsp. japonica]
MAGGGVWVFRNNGVMELEEQATSRKALVHVATSEVIRSTEALERRLGALGWERYYEDRATLQLHRR
DGSADLISIPRDFSRFRSTHMYDVVVKNRDHFKVVDLHT SEQ ID NO: 130, NM_122395.4 Arabidopsis thaliana FPF1 (FLOWERING PROMOTING FACTOR 1) (FPF1) mRNA, complete cds
AAATCATTCAAGAAACCAAAACTAAGGAGAGGAAGAAGAAGATCATGTCAGGCGTGTGGGTCTTCA
AGAACGGAGTGATAAGACTTGTGGAGAACCCTAACCAGTCAGGATCCGACACACAGAACCGAAGGA
AAGTGATGGTCTATTTACCGACAGGAGAAGTGGTCTCATCTTACTCGACGCTCGAGCAGATCCTCC
AGAGTCTTGGATGGGAGAGATACTTTGGCGGCGGCGACACAGATCTCCTCCAATTCCACAAACGCT
CCTCCATTGATCTCATTTCCCTGCCTAGAGATTTCACCAAATTCAACTCCGTTTACATGTACGATA
TCGTCGTCAAGAACCCTAATTACTTCCATGTCCGAGACTCCCATTGATTCTTCTTTTGTGTGTTGG
TGTGTGTGTTGTGTTCGGTTGTTTTATAATTTAGAGTTTGTTGGGTTTTGTTTTATAGTTGCATGT
GCATGTTTTATTTGTTTTGGACGTTGGAAGTTGTGTTACGTAATTCTGGTTTGATGAAAGTTGAGA
TTAAGAAGGGACATGAATTAGGGAGAACTCAATTTCAAAATTAATTGTTCTCTTCCTTAGCATGAT
TGTTCTCTTCACTGGTTGTAATTGAAAGATATTCTCTTTGGCTCAGTGGATCCAAATTGTTTTCTA
TCTTCTATTTAA SEQ ID NO: 131, O23624_ARATH_FPF1 protein (At5g24860). [Arabidopsis thaliana]
MSGVWVFKNGVIRLVENPNQSGSDTQNRRKVMVYLPTGEVVSSYSTLEQILQSLGWERYFGGGDTD
LLQFHKRSSIDLISLPRDFTKFNSVYMYDIVVKNPNYFHVRDSH SEQ ID NO: 132, NM_001051839.1 Oryza sativa (japonica cultivar-group) Os01g0933500 (Os01g0933500) mRNA, complete cds
CGAAGGGAGGATCGAGGAATTCAGTTAAGCAAAAATATTTATACATGTCGGGCGTGTGGGTGTTCC
GGAACGGGGTGGTGAAGCTGGTGGAGAACCCGCCGGCGTCGGCGAACAGCGGCGGCGGCGGCGGCG
GCGGCGGCGGCGGTGGCGGCGGCGGCATCCGGCGCAAGGCGCTGCTGCACATGCCGACGGGTGAGG
TGGTCACCTCCTACGCCTCCCTGGAGCGCAAGCTCGCCGCGCTCGGCTGGGAGCGCTACTACTCCG
GCGGCGGCGGCGCCGCCGCCGCCGCCGCCATGATGCTCCAGTTCCACAAGCGCTCGTCGGTGGACC
TGATCTCGCTGCCCAAGGACTTCTCCCAGTTCGGCTCCGTCCACATGTACGACATCGTCGTCAAGA
ACCGCGACGCCTTCCGAGTCATCGACGTCTAATCACCCAAGTGTCT SEQ ID NO: 133, Q8LR63_ORYSJ_FPF1 protein-like (Os01g0933500 protein) (Gravity and root development protein). [Oryza sativa subsp. japonica]
MSGVWVFRNGVVKLVENPPASANSGGGGGGGGGGGGIRRKALLHMPTGEVVTSYASLERKLAAL
GWERYYSGGGGAAAAAAMMLQFHKRSSVDLISLPKDFSQFGSVHMYDIVVKNRDAFRVIDV FIGURE 10 (continued)

SEQ ID NO: 134, CAB89380, F12B17_20, FPF1 protein-like, strong similarity to FPF1 protein, Arabidopsis thaliana, EMBL:ATFPF1
ATGTCAGGAGTTTGGGTGTTCAATAACGGAGTGATACGTCTAGTGGAGAACCCGAACCAGTCCGGT
GGAGTTTCCACACAGTCGCACGGCCGGAGAAATGTCTTGGTTTACTTGCCGACCGGTGAAGCCGTC
TCATCTTACTCGTCGCTCGAACAAATCCTAAGGAGCCTCGGGTGGGAAAGATACTTCAGTGGAGAC
TCCGATCTCATCCAGTACCACAAACGCTCCTCCATCGACCTCATCTCCTTACCAAGAGACTTCTCC
AAGTTCAACTCCGTTTACATGTACGACATCGTTGTCAAGAACCCTAATTCCTTCCACGTCCGCGAT
TTCAATTGA SEQ ID NO: 135, Q9LXB5_ARATH_FPF1 protein-like (At5g10630). [Arabidopsis thaliana]
MSGVWVFNNGVIRLVENPNQSGGVSTQSHGRRNVLVYLPTGEAVSSYSSLEQILRSLGWERYFSGD
SDLIQYHKRSSIDLISLPRDFSKFNSVYMYDIVVKNPNSFHVRDFN SEQ ID NO: 136, AY924826.1:1..546, At4g31380, hypothetical protein, Arabidopsis thaliana
ATGATAATCTACTTGTCAGTCTACACACCCCTTTACCAACATATATATATATATAGCACACACT
CTACACGGTTTCCTTATCCTCATCAAAATTAACAAACTCATTTTTGAATACCCAAAAAAAAACCTA
GCTAGCTCGAATTTTTTTAAATATATAATAACATCAACAATGTCTGGTGTGTGGGTATTCAACAAA
AACGGAGTCATGAGGCTGGTGGAGAATCCTTACAACCAATCCGCCGGAGATTCGTCGGAATCGTCC
TCTTCCGGTGGTAACCAGCAGCAGAGGATGAGGAGGAAAATTCTCGTCCATCTTCCAAGCAGCGAG
GTTGTGTCTTCGTACGGATCACTTGAGAAGATCTTGAAGAATCTTGGTGGGAGAGGTACTACAGT
GGAGACAATACCGATCATCTGCTCCAGTTCCACAAGAGAACTTCGATCGATCTCATCTCTCTCCCT
CGTGACTTCTCCAAGTTTAACTCTATTCACATGTATGATATCGTCGTCAAGAACCCTAACGTCTTC
CATGTCCGTGACATGTAG SEQ ID NO: 137, Q5Q0B3_ARATH_Putative uncharacterized protein. [Arabidopsis thaliana]
MIIYLSVYTPLYQHIYIYIAHTLHGFLILIKINKLIFEYPKKNLASSNFFKYIITSTMSGVWVFNK
NGVMRLVENPYNQSAGDSSESSSSGGNQQQRMRRKILVHLPSSEVVSSYGSLEKILKNLGWERYYS
GDNTDHLLQFHKRTSIDLISLPRDFSKFNSIHMYDIVVKNPNVFHVRDM SEQ ID NO:138 TC301416 Oryza sativa (japonica cultivar-group) cDNA clone:J013034O10, full insert sequence
GGCACCACCACCATTGCTGAGCTCCAAAGCTTCTAGCTGTGATCAAGCAAAGAAGAATTGAAAAAA
AACATATATATATTATATATATGGCAGGGGTGTGGGTGTTTGAGGATGGGATGGTGAGGAGGGCAG
ATAGCGAGGCGCCGTCGAGAGGGCGCGGTGTCGGTGGTGGAGGTGGGGGAGGGAAGGTGCTTGTGC
ACGTGCCGAGCAGCGAGGTGGTGACGAGCTACGAGGTTCTGGAGAGGCGGCTGCGGGAGCTCGGGT
GGGAGAGGTACCTCAACGACCCGTGCCTCCTCCAGTTCCACCAGCGCTCCACCGTCCACCTCATCT
CCGTGCCCCGCGACTTCTCCCGCCTCAAGCTCGTCCACATGTACGACGTCGTCGTCAAGACCCGCA
ACGTCTTCGAGGTCCGTGACGCCGCCACCACTGCTTCCCCGCCATGATCGCATCGATGTCTATGCT
TTGATCATCATCGATATGACCTTCCTCGACTCCGGGCTCAGGCCAGACACGCCGCCATGGCGCCTA
CAATCGTATGTGTGTATTGTATGAATCTCAATTCAGGTAATGAATGATTGTATATCATATGATTTG
TAATTCTGTACAGGTATAACGTATGCGTATATACGTACGTGTGCGATCGATCGGGTGTGTGTGATA
TATATTAAAATAAGCGTGGCTGGTTTAATTGCAAGTGAGTGTTTAGTTATTTAATTATACGAGAGC
CATGAGCACGTGTGTAGCTAGCTTTGGAGTCTTGTACTTTGTGGTTTGGAGCCATTGCTTGACTGA
TTCCGTGGCACGAATCAATCATCCATGCGTTATGCAGTGACAATAAATAATTAGTTTTGTCACAAT
TAATTAATAGTATGTTGTTTGCTGTATTGATTAAAAAACAA FIGURE 10 (continued)

SEQ ID NO:139 Q7XX25_ORYSJ_OSJNBa0071G03.4 protein (Putative uncharacterized protein). [Oryza sativa subsp. japonica]
MAGVWVFEDGMVRRADSEAPSRGRGVGGGGGGKVLVHVPSSEVVTSYEVLERRLRELGWERYLND
PCLLQFHQRSTVHLISVPRDFSRLKLVHMYDVVVKTRNVFEV

SEQ ID NO: 140, EAY73364, OsI_001211, Oryza sativa subsp. indica, hypothetical protein
ATGTCAGGGGTTTGGCTGTTCAAGAACGGGGTGGTGAGATTGGTGGAGAAGCAGCAGGCGACGGCG
GGGACGTCGGTGGCGGGAGGGAGGAGGAAGGCGCTGGTGCACACGCCGAGCGGGCAGGTGGTGTCG
TCGTACGCGGCGCTGGAGGCGCGGCTGACGGCGCTCGGGTGGGAGCGCTACTACGAGGACCCCTCC
CTCTTCCAGTTCCACAAGCGTGGCTCCCTCGACCTCATCTCCCTCCCCGCCGACTTCTCCGCCTTC
TCCTCCGTCCACATGTACGACATCGTCGTCAAGAACCGCGACTCCTTCCGCGTCGTCGACGCCTAA

SEQ ID NO: 141, A2WN18_ORYSI_Putative uncharacterized protein. [Oryza sativa subsp. indica]
MSGVWLFKNGVVRLVEKQQATAGTSVAGGRRKALVHTPSGQVVSSYAALEARLTALGWERYYEDPS
LFQFHKRGSLDLISLPADFSAFSSVHMYDIVVKNRDSFRVVDA

SEQ ID NO: 142, CAA72716, FPF1, Sinapis alba
ATGTCAGGCGTGTGGGTGTTCAAGAACGGAGTGATAAGGCTTGTGGAGAACCCTAACCAGTCAGGA
GGCGACACAAATAGCCGAAGGAAAGTGATGGTCTATTTACCGACAGGAGAAGTGATCTCATCTTAC
TCCACGCTCGAGCAGATCCTCCGGAGTCTTGGATGGGAGAGGTACTTCGGTGGCGGCGACACAGAT
CTTCTCCAATTCCACAAACGCTCATCCATTGATCTCATCTCTCTCCCTAAAGATTTCACCAAATTC
AGCTCTGTTTACATGTACGATATTGTCGTCAAGAACCCTAATTACTTCCACGTCCGAGACTCCAAT
TAA

SEQ ID NO: 143, O24340_SINAL_FPF1 protein. [Sinapis alba]
MSGVWVFKNGVIRLVENPNQSGGDTNSRRKVMVYLPTGEVISSYSTLEQILRSLGWERYFGGGDTD
LLQFHKRSSIDLISLPKDFTKFSSVYMYDIVVKNPNYFHVRDSN

SEQ ID NO: 144, EAY85756, OsI_006989, Oryza sativa subsp. Indica, similar to RNA sequence, EST similar to RNA sequence, mRNA similar to Arabidopsis Gene Ontology: GO:0005509 calcium ion binding
ATGGCGGGCGTGTGGGTGTTCAAGGACGGCATCGTGCGGCGCGTGGAGAACCCCGGCAGCGAGGAA
TCGTCGTCGGCGGGGAACGGCGGCGGAGGCGGGCGGCGGAAGGTGCTGGTGCACGTGCCGAGCGGG
GAGGTGGTGGCGTCATACGAGGTGCTGGAGCGGCGGCTGCGGGAGCTCGGGTGGGAGAGGTACCTC
ACCGACCCGTGCCTCCTGCAGTTCCACCAGCGCTCCACCGTGCACCTCATCTCTGTCCCCGCGAC
TTCTCCAAGTTCAAGCTCGTCCACATGTACGACATCGTCGTCAAGACCCGCAACGTCTTCGAGGTC
CGCGACGCCGCCGCCCCGCCGTCTCACCGGCGACCTAG

SEQ ID NO: 145, A2X4J6_ORYSI_Putative uncharacterized protein. [Oryza sativa subsp. indica]
MAGVWVFKDGIVRRVENPGSEESSSAGNGGGGGRRKVLVHVPSGEVVASYEVLERRLRELGWERYL
TDPCLLQFHQRSTVHLISVPRDFSKFKLVHMYDIVVKTRNVFEVRDAAAPAVSPAT

FIGURE 10 (continued)

SEQ ID NO: 146, NM_001053322.1 Oryza sativa (japonica cultivar-group) Os02g0460200 (Os02g0460200) mRNA, complete cds organism|oryza sativa (japonica cultivar-group)
AGCGGCTGTATAGCTGCTGCCACTCAACTGTGCAGGACTCCTAGCTCCCTGCTACATATACCGGCC
GGTCGGACCCCCTCATCTTGCCGGCCTCATCATCGTCACCGATCGATCCCGGCCATTCCACGGTCG
ATCGATCGTCTCCGGCCGGCCGGTCGCCGGTGGAATTGAAGCAGCTAGCTGACATACATACATGG
CGGGCGTGTGGGTGTTCAAGGACGGCATCGTGCGGCGCGTGGAGAACCCCGGCAGCGAGGAATCGT
CGTCGGCGGGGGACGGCGGCGGAGGCGGGCGGCGGAAGGTGCTGGTGCACGTGCCGAGCGGGGAGG
TGGTGGCGTCATACGAGGTGCTGGAGCGGCGGCTGCGGGAGCTCGGGTGGGAGAGGTACCTCACCG
ACCCGTGCCTCCTGCAGTTCCACCAGCGCTCCACCGTGCACCTCATCTCTGTCCCCGCGACTTCT
CCAAGTTCAAGCTCGTCCACATGTACGACATCGTCGTCAAGACCCGCAACGTCTTCGAGGTCCGCG
ACGCCGCTGCCCCCGCCGTCTCACCGGCGACCTAGCTGCTGATCCGAGATCCATCCATCCATCGAT
CAGACGACAGCTTATAGCTACAGCAGTCCACATGAGCTTGCCTGCCTGCTATTATAAGAGTGTAAG
TATGTATATATACTGGTATGCGTGTGATCGATCAAGGATCGATGTACACACAAATGATCAGCAT
GCACAGATCACTAGATCGAGATCTATAGCTCGATCGATTTGGGGTTTCTCCTGCCGGCGTTGCAGC
TTTTGGATTAGATGTTGCGCCGGTGAGGACATTGCTATAGGTTAATTGGCTTTTGGGTATATTTCT
GCATAAATAATGCATCAATAGAGAGCACAACATGTGTATGCATACTTATATTTATATGTACACATG
CATACATATATAAGTACATACATAGGGGCCGGGGGCAACATGCAGGTTGCAGAGATTCTGCCAGAG
ATCAAGCAGAAAGGGGATCGCCGATGCCCTACTCTCAACCGTACCTTTTTACTGTTTAATTTGGAA
TAATTTGGATTGTCTCAATACAAATTATGTACCAGTTTTTC SEQ ID NO: 147, Q0E1D7_ORYSJ_Os02g0460200 protein (Putative uncharacterized protein). [Oryza sativa subsp. japonica]
MAGVWVFKDGIVRRVENPGSEESSSAGDGGGGGRRKVLVHVPSGEVVASYEVLERRLRELGWERYL
TDPCLLQFHQRSTVHLISVPRDFSKFKLVHMYDIVVKTRNVFEVRDAAAPAVSPAT SEQ ID NO: 148, F3L17.1, FPF1 LIKE PROTEIN 1, AT4G31380.1: similar to expressed protein [Arabidopsis thaliana] (TAIR:At5g10625.1); similar to gravity and root development protein [Oryza sativa (japonica cultivar-group)]
CGAAAATTCTGGAATTCTGCATTTAATATATATATATATATCATATAATATAATGATAATCTACTT
GTCAGTCTACACACCCCTTTACCAACATATATATATATATAGCACACACTCTACACGGTTTCCT
TATCCTCATCAAAATTAACAAACTCATTTTTGAATACCCAAAAAAAAACCTAGCTAGCTCGAATTT
TTTTAAATATATAATAACATCAACAATGTCTGGTGTGTGGGTATTCAACAAAAACGGAGTCATGAG
GCTGGTGGAGAATCCTTACAACCAATCCGCCGGAGATTCGTCGGAATCGTCCTCTTCCGGTGGTAA
CCAGCAGCAGAGGATGAGGAGGAAAATTCTCGTCCATCTTCCAAGCAGCGAGGTTGTGTCTTCGTA
CGGATCACTTGAGAAGATCTTGAAGAATCTTGGTGGGAGAGGTACTACAGTGGAGACAATACCGA
TCATCTGCTCCAGTTCCACAAGAGAACTTCGATCGATCTCATCTCTCTCCCTCGTGACTTCTCCAA
GTTTAACTCTATTCACATGTATGATATCGTCGTCAAGAACCCTAACGTCTTCCATGTCCGTGACAT
GTAGTAGTCAATCATCCAAAACAATGGTTCAATATCATTCTCCGATCATCGCCGCTGGTGATATAT
CTATCATGTATATATATGCAGGTTTTTATTTTGTCGTTGGGTGTTTTTGTTTTTGGTTTATTTT
GTTTTTAATGCATTTAATGTACGTGTTTTCCGTTCGACGTCGATCGATTGGGGTGGGTTCAAGCTA
GAGCCATTCTAATAACTTTTATCATTTTGTGATTTTAATGAAATTGTATCATGTTGTCAAGTTCTC
TTATTATGGAGTGGATCAAAAAATATATACAGTACATCAAATTTCGAATGTTATATGATGAAATAT
CATAATTTGG

FIGURE 10 (continued)

SEQ ID NO: 149, O49587_ARATH_Putative uncharacterized protein AT4g31380. [Arabidopsis thaliana]
MSGVWVFNKNGVMRLVENPYNQSAGDSSESSSSGGNQQQRMRRKILVHLPSSEVVSSYGSLEKILK
NLGWERYYSGDNTDHLLQFHKRTSIDLISLPRDFSKFNSIHMYDIVVKNPNVFHVRDM

SEQ ID NO: 150, EAY93400, OsI_014633, Oryza sativa subsp. Indica, similar to RNA sequence, EST similar to Arabidopsis, Gene Ontology: GO:0003924 GTPase activity; GO:0005509 calcium ion binding; GO:0005525 GTP binding; GO:0007018 microtubule-based movement; GO:0045298 tubulin; GO:0046785 microtubule polymerization
ATGGCAGGGGTGTGGGTGTTTGAGGATGGGATGGTGAGGAGGGCAGATAGCGAGGCGCCGTCGAGA
GGGCGCGGTGTCGGTGGTGGAGGTGGGGGAGGGAAGGTGCTTGTGCACGTGCCGAGCAGCGAGGTG
GTGACGAGCTACGAGGTTCTGGAGAGGCGGCTGCGGGAGCTCGGGTGGGAGAGGTACCTCAACGAC
CCGTGCCTCCTCCAGTTCCACCAGCGCTCCACCGTCCACCTCATCTCCGTGCCCCGCGACTTCTCC
CGCCTCAAGCTCGTCCACATGTACGACGTCGTCGTCAAGACCCGCAACGTCTTCGAGGTCCGCGAC
GCCGCCACCACTGCTGCCCCGCCATGA

SEQ ID NO: 151, A2XRE0_ORYSI_Putative uncharacterized protein. [Oryza sativa subsp. indica]
MAGVWVFEDGMVRRADSEAPSRGRGVGGGGGGGKVLVHVPSSEVVTSYEVLERRLRELGWERYLND
PCLLQFHQRSTVHLISVPRDFSRLKLVHMYDVVVKTRNVFEVRDAATTAAPP

SEQ ID NO: 152, AAR97604, flowering promoting factor-like 1, FPF1, Nicotiana tabacum
ATGTCTGGAGTTTGGGTATTCAAGAATGGAGTTGTCCGACTTGAAGATTGTCAAGGCTCAAGTGGT
CGTCGAAAAGTGTTAGTTCATGTTCCAAGTAATGAAGTCATCACATCCTATGCAGTACTTGAAAGG
AAACTTCATTCTCTTGGTTGGGAAAGGTATTATGATGATCTTGACCTTCTTCAGTACCATAAAAGA
TCAACTGTTCATCTCATTTCTCTCCCAAAAGATTTCAACAAGTTGAAGCCCATGCACATGTACGAT
ATTGTCGTCAAGAATCGCAATGAGTTTGAAGTTAGAGACATATGA

SEQ ID NO: 153, Q6RIB0_TOBAC_Flowering promoting factor-like 1. [Nicotiana tabacum]
MSGVWVFKNGVVRLEDCQGSSGRRKVLVHVPSNEVITSYAVLERKLHSLGWERYYDDLDLLQYHKR
STVHLISLPKDFNKLKPMHMYDIVVKNRNEFEVRDI

SEQ ID NO: 154, Arabidopsis thaliana, CAB89379, similarity to KIAA1038 protein (AB028961, Homo sapiens)
ATGTCAGGAGTTTGGGTGTTCAATAACGGAGTGATACGTCTAGTGGAGAACCCGAACCAGTCCGGT
GGAGTTTCCACACAGTCGCACGGCCGGAGAAATGTCTTGGTTTACTTGCCGACCGGTGAAGCCGTC
TCATCTTACTCGTCGCTCGAACAAATCCTAAGGAGCCTCGGGTGGAAAGATACTTCAGTGGAGAC
TCCGATCTCATCCAGTACCACAAACGCTCCTCCATCGACCTCATCTCCTTACCAAGAGACTTCTCC
AAGTTCAACTCCGTTTACATGTACGACATCGTTGTCAAGAACCCTAATTCCTTCCACAAACAAACG
ATGCCTCGTAAAGGATTATCCAATTTCGATGATTATGATGATGGTTTTGATGATGATGACGATGCT
TTTGATTATGACTATGATGTTGATATAGATGAACATGAAGAAGAAGCTGCTGCTGAACCAAAGGAA
GAAATTGCTAAAACGCAAGGGCTTTGGCGATGTGCTATCTGTACATATGACAATGTTGAGACTATG
TTTGTGTGTGATATCTGCGGTGTTCTTCGTCATCCTGTCGCCGGAAATCAAAGTATCAATAAGAAT
ACAGCTGTTCGTGTTGTGAGTCTCTTTGCAATTGTGGTGTTGCAAAGGCGTTATTCTGACAGTTCC
TTTTCAACTTATGTAGCACCTTTCAAGTTTGATGCTCCATCGCCAGATGATTTAGTCTCCAATGGA CTAACATCCTCAAAAACTGGTCCAAAAGGCTCAGGTGATGCTAGCATGAGACAGAAGGAGAAGCAA
GATAGCGTAGAACAGAAACCTTTAAAGAAAGGAGGAGATAGTTCAGAAACAAGCTCCCGAGGTAGA
CATGATAAACTTGATGATAAGGGCGGTGCTGGCGGCATAAAATCAGGCAAAAGTTTGCCAAAAGCA
AAAGCAGATATGTCTAATGAGACAAGTTCGTCCTCTAAATATATGGAGACGTCGGAGAGTCTTACT
GGTACTATGAACAAGATGTCTTTGATTGGGGAAACAGAAACTCTAGCGATATTAAAATTAGAGGA
CCAAAATCACAATCTAAGCATAAGCCAGAGGAGTGGATGCTTCTTGATAAAGAATCAGATGCACTA
AGCCAGCTTAATCTTGCCATCGTGGGGCATGTTGATTCCGGTAAGTCTACACTTTCGGGTAGATTA
TTGCATCTTTTGGGAAGAATATCGCAGAAGCAAATGCACAAGTATGAGAAAGAAGCAAAGTTGCAG
GGCAAAGGGTCCTTTGCATATGCCTGGGCATTGGATGAGAGTGCTGAAGAGAGGGAACGAGGAATA
ACAATGACTGTGGCTGTTGCTTATTTCAATTCCAAAAGACATCATGTTGTTTTGCTCGACTCTCCT
GGACACAAAGATTTTGTTCCAAACATGATAGCAGGAGCAACACAAGCAGATGCTGCGATTCTTGTC
ATAGATGCATCTGTTGGTGCTTTTGAAGCTGGTTTTGATAATTTGAAAGGGCAGACAAGGGAGCAT
GCACGGGTTCTGAGAGGTTTTGGCGTGGAGCAAGTCATAGTTGCAATCAACAAAATGGATATTGTT
GGCTACTCAAAGGAAAGATTTGATTTGATTAAGCAGCACGTTGGATCTTTTTTGCAATCCTGTCGT
TTTAAGGATTCTTCTCTGACATGGATTCCATTAAGTGCCATGGAAAACCAAAACTTGGTGGCAGCT
CCCTCTGATAACCGCCTATCCTCATGGTATCAAGGTCCATGTTTATTGGATGCCGTCGACTCTGTC
AAGTCTCCTGATAGAGACGTCTCAAAGCCTCTACTCATGCCTATATGTGACGCTGTAAGATCAACT
TCGCAAGGGCAGGTATCTGCATGTGGCAAACTTGAAGCTGGAGCTGTCCGGCCAGGATCTAAGGTA
ATGGTTATGCCATCAGGAGATCAAGGAACCATACGATCACTAGAGCGTGACTCTCAGGCTTGCACC
ATTGCAAGAGCTGGAGATAACGTAGCGTTAGCGTTGCAAGGGATCGATGCAAATCAAGTAATGGCA
GGAGATGTATTGTGCCATCCTGATTTCCCTGTATCAGTAGCAACTCATTTGGAATTGATGGTGCTC
GTCTTGGAAGGCGCAACACCGATCTTGCTCGGTTCTCAGTTGGAGTTTCATGTGCATCATGCAAAG
GAAGCAGCAACAGTTGTGAAACTTGTGGCAATGCTTGATCCCAAAACAGGGCAGCCAACAAAGAAG
TCTCCTCGTTGTCTAACTGCTAAACAGAGCGCAATGCTTGAGGTTAGTCTCCAAAATCCAGTATGT
GTGGAGACATTTTCTGAGAGTAGAGCTCTTGGAAGAGTGTTCCTTAGATCATCGGGAAGAACTGTT
GCTATGGGCAAAGTTACTCGGATTATCCAAGACTCATAA

SEQ ID NO: 155, Q9LXB6_ARATH_Putative uncharacterized protein F12B17_10. [Arabidopsis thaliana]
MSGVWVFNNGVIRLVENPNQSGGVSTQSHGRRNVLVYLPTGEAVSSYSSLEQILRSLGWERYFSGD
SDLIQYHKRSSIDLISLPRDFSKFNSVYMYDIVVKNPNSFHKQTMPRKGLSNFDDYDDGFDDDDDA
FDYDYDVDIDEHEEEAAAEPKEEIAKTQGLWRCAICTYDNVETMFVCDICGVLRHPVAGNQSINKN
TAVRVVSLFAIVVLQRRYSDSSFSTYVAPFKFDAPSPDDLVSNGLTSSKTGPKGSGDASMRQKEKQ
DSVEQKPLKKGGDSSETSSRGRHDKLDDKGGAGGIKSGKSLPKAKADMSNETSSSSKYMETSESLT
GTMNKMSLIGETENSSDIKIRGPKSQSKHKPEEWMLLDKESDALSQLNLAIVGHVDSGKSTLSGRL
LHLLGRISQKQMHKYEKEAKLQGKGSFAYAWALDESAEERERGITMTVAVAYFNSKRHHVVLLDSP
GHKDFVPNMIAGATQADAAILVIDASVGAFEAGFDNLKGQTREHARVLRGFGVEQVIVAINKMDIV
GYSKERFDLIKQHVGSFLQSCRFKDSSLTWIPLSAMENQNLVAAPSDNRLSSWYQGPCLLDAVDSV
KSPDRDVSKPLLMPICDAVRSTSQGQVSACGKLEAGAVRPGSKVMVPSGDQGTIRSLERDSQACT
IARAGDNVALALQGIDANQVMAGDVLCHPDFPVSVATHLELMVLVLEGATPILLGSQLEFHVHHAK
EEAATVVKLVAMLDPKTGQPTKKSPRCLTAKQSAMLEVSLQNPVCVETFSESRALGRVFLRSSGRTV
AMGKVTRIIQDS

SEQ ID NO: 156, NM_001058903.1 name|Oryza sativa (japonica cultivar-group) Os04g0282400 (Os04g0282400) mRNA, complete cds
GCACCACCACCATTGCTGAGCTCCAAAGCTTCTAGCTGTGATCAAGCAAAGAAGAATTGAAAAAAA
ACATATATATATTATATATATGGCAGGGGTGTGGGTGTTTGAGGATGGGATGGTGAGGAGGGCAGA
TAGCGAGGCGCCGTCGAGAGGGCGCGGTGTCGGTGGTGGAGGTGGGGGAGGGAAGGTGCTTGTGCA FIGURE 10 (continued)

```
CGTGCCGAGCAGCGAGGTGGTGACGAGCTACGAGGTTCTGGAGAGGCGGCTGCGGGAGCTCGGGTG
GGAGAGGTACCTCAACGACCCGTGCCTCCTCCAGTTCCACCAGCGCTCCACCGTCCACCTCATCTC
CGTGCCCCGCGACTTCTCCCGCCTCAAGCTCGTCCACATGTACGACGTCGTCGTCAAGACCCGCAA
CGTCTTCGAGGTCCGTGACGCCGCCACCACTGCTTCCCCGCCATGATCGCATCGATGTCTATGCTT
TGATCATCATCGATATGACCTTCCTCGACTCCGGGCTCAGGCCAGACACGCCGCCATGGCGCCTAC
AATCGTATGTGTGTATTGTATGAATCTCAATTCAGGTAATGAATGATTGTATATCATATGATTTGT
AATTCTGTACAGGTATAACGTATGCGTATATACGTACGTGTGCGATCGATCGGGTGTGTGTGATAT
ATATTAAAATAAGCGTGGCTGGTTTAATTGCAAGTGAGTGTTTAGTTATTTAATTATACGAGAGCC
ATGAGCACGTGTGTAGCTAGCTTTGGAGTCTTGTACTTTGTGGTTTGGAGCCATTGCTTGACTGAT
TCCGTGGCACGAATCAATCATCCATGCGTTATGCAGTGACAATAAATAATTAGTTTTGTC
```

SEQ ID NO: 147, Q0JEF5_ORYSJ_Os04g0282400 protein. [Oryza sativa subsp. japonica]
MAGVWVFEDGMVRRADSEAPSRGRGVGGGGGGGKVLVHVPSSEVVTSYEVLERRLRELGWERYLND
PCLLQFHQRSTVHLISVPRDFSRLKLVHMYDVVVKTRNVFEVRDAATTASPP

SEQ ID NO: 158, NM_001056626, Oryza sativa (japonica cultivar-group) Os03g0346200 (Os03g0346200) mRNA, complete cds
```
ATGGGGTCGCTGCAGGCGCTGGAGCGGAGGCTGGCGGGGCTCGGGTGGGAGCGCTACTACGAGGAC
CGCGCCGTGGTGCAGCTCCACCGCCGCGACGGCGGCGCCGACCTCATCTCCCTCCCCCGCGACTTC
GCCCGCTTCCGCTCCACCCACATGTACGACGTCGTCCTCAAGAACCGCGACCACTTCAAGGGAGGA
AGCGCAGAGGAGAGGGCGTGGCTCCGTCGGCTGTCGGCGACCTCGACGGCGGCGGGAGGTGGCCCC
GGCTGCGGTGGCGCTAAGGATCGGAGTGGCAGCCGGTGGTAG
```

SEQ ID NO: 159, NP_001050091, Os03g0346200 [Oryza sativa (japonica cultivar-group)], Conserved hypothetical protein ab initio prediction with EST support
MGSLQALERRLAGLGWERYYEDRAVVQLHRRDGGADLISLPRDFARFRSTHMYDVVLKNRDHFKGG
SAEERAWLRRLSATSTAAGGGPGCGGAKDRSGSRW

SEQ ID NO: 160, CAN81644.1, hypothetical protein, highly similar to EMBL:Y11987
```
ATGTCTGGTGTTTGGGTATTCGACAAGAATGGCGTGGCCCGGCTCGTACGAACCCGACCCGGGAGT
CGTTCGAACAAAAGGAGCCGCCATTTCCGGGCACAGCCACCGCCCCAGGTGCACGTCCACGGCTTC
TGGTGTACCTCCCAGAGAATCAGGTGATTCGAAGCTACACGGAACTGGAGCAGCGACTGAACCAAC
TGGGGTGGAGTCGGTACCACAACTACCAGCATCCCAGCCTGGTCCAGTTCCACAAGTCCGACAACT
CTTCTCACCTCCTGTCCCTCCCCAAAAGCTTTGCCAACTTCAAGTCTTTTCACTTTTACGATATCG
TCGTCAAGAATCGATCTTTCTTTGAAGTCCGCGAGGCCTGA
```

SEQ ID NO: 161, A5BZJ2_VITVI, Putative uncharacterized protein, Vitis vinifera.
MSGVWVFDKNGVARLVTNPTRESFEQKEPPFPGTATAPGARPRLLVYLPENQVIRSYTELEQRLNQ
LGWSRYHNYQHPSLVQFHKSDNSSHLLSLPKSFANFKSFHFYDIVVKNRSFFEVREA

SEQ ID NO: 162, motif 1:
GVW(V/L)F

SEQ ID NO: 163, motif 2:
LGW(E/S)RY(Y/F)

FIGURE 10 (continued)

SEQ ID NO: 164, motif 3:
(D/H)L(L/I)S(I/V/L)P(R/K/A)(S/D)F

SEQ ID NO: 165, motif 4:
(H/Y)(F/M)YD(V/I)VVK(N/T)(R/P)

SEQ ID NO: 166, GOS2-RAA1-like expression cassette, start and stop codon in bold.
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTCCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTTCGATCCATATCTTCCGGTCGAGTTCTTGG
TCGATCTCTTCCCTCCTCCACCTCCTCCTCACAGGGTATGTGCCCTTCGGTTGTTCTTGGATTTAT
TGTTCTAGGTTGTGTAGTACGGGCGTTGATGTTAGGAAAGGGGATCTGTATCTGTGATGATTCCTG
TTCTTGGATTTGGGATAGAGGGGTTCTTGATGTTGCATGTTATCGGTCGGTTTGATTAGTAGTAT
GGTTTTCAATCGTCTGGAGAGCTCTATGGAAATGAAATGGTTTAGGGTACGGAATCTTGCGATTTT
GTGAGTACCTTTTGTTTGAGGTAAAATCAGAGCACCGGTGATTTTGCTTGGTGTAATAAAAGTACG
GTTGTTTGGTCCTCGATTCTGGTAGTGATGCTTCTCGATTTGACGAAGCTATCCTTTGTTTATTCC
CTATTGAACAAAAATAATCCAACTTTGAAGACGGTCCCGTTGATGAGATTGAATGATTGATTCTTA
AGCCTGTCCAAAATTTCGCAGCTGGCTTGTTTAGATACAGTAGTCCCCATCACGAAATTCATGGAA
ACAGTTATAATCCTCAGGAACAGGGGATTCCCTGTTCTTCCGATTTGCTTTAGTCCCAGAATTTTT
TTTCCCAAATATCTTAAAAAGTCACTTTCTGGTTCAGTTCAATGAATTGATTGCTACAAATAATGC
TTTTATAGCGTTATCCTAGCTGTAGTTCAGTTAATAGGTAATACCCCTATAGTTTAGTCAGGAGAA
GAACTTATCCGATTTCTGATCTCCATTTTTAATTATATGAAATGAACTGTAGCATAAGCAGTATTC
ATTTGGATTATTTTTTTATTAGCTCTCACCCCTTCATTATTCTGAGCTGAAAGTCTGGCATGAAC
TGTCCTCAATTTTGTTTTCAAATTCACATCGATTATCTATGCATTATCCTCTTGTATCTACCTGTA
GAAGTTTCTTTTTGGTTATTCCTTGACTGCTTGATTACAGAAAGAAATTTATGAAGCTGTAATCGG
GATAGTTATACTGCTTGTTCTTATGATTCATTTCCTTTGTGCAGTTCTTGGTGTAGCTTGCCACTT
TCACCAGCAAAGTTCATTTAAATCAACTAGGGATATCACAAGTTTGTACAAAAAAGCAGGCTTAAA
CAATGTCAGGGGTTTGGGTGTTCAAGAACGGGGTGGTGAGATTGGTGGAGAAGCAGCAGGCGACGG
CGGGGACGGCGGTGGCGGGAGGGAGGAGGAAGGCGCTGGTGCACACGCCGAGCGGGCAGGTGGTGT
CGTCGTACGCGGCGCTGGAGGCGCGGCTGACGGCGCTCGGGTGGGAGCGCTACTACGAGGACCCCT
CCCTCTTCCAGTTCCACAAGCGTGGCTCCCTCGACCTCATCTCCCTCCCCGCCGACTTCTCCGCCT
TCTCCTCCGTCCACATGTACGACATCGTCGTCAAGAACCGCGACTCCTTCCGCGTCGTCGACGCC**T
AA**AT FIGURE 10 (continued)

SEQ ID NO: 167, HMGP-RAA1-like combination, start and stop codon in bold

CATGCGGCTAATGTAGATGCTCACTGCGCTAGTAGTAAGGTACTCCAGTACATTATGGAATATACA
AAGCTGTAATACTCGTATCAGCAAGAGAGAGGCACACAAGTTGTAGCAGTAGCACAGGATTAGAAA
AACGGGACGACAAATAGTAATGGAAAAACAAAAAAAAACAAGGAAACACATGGCAATATAAATGGA
GAAATCACAAGAGGAACAGAATCCGGGCAATACGCTGCGAAAGTACTCGTACGTAAAAAAAAGAGG
CGCATTCATGTGTGGACAGCGTGCAGCAGAAGCAGGGATTTGAAACCACTCAAATCCACCACTGCA
AACCTTCAAACGAGGCCATGGTTTGAAGCATAGAAAGCACAGGTAAGAAGCACAACGCCCTCGCTC
TCCACCCTCCCACCCAATCGCGACGCACCTCGCGGATCGGTGACGTGGCCTCGCCCCCAAAAATA
TCCCGCGGCGTGAAGCTGACACCCCGGGCCCACCCACCTGTCACGTTGGCACATGTTGGTTATGGT
TCCCGGCCGCACCAAAATATCAACGCGGCGCGGCCCAAAATTTCCAAAATCCCGCCCAAGCCCCTG
GCGCGTGCCGCTCTTCCACCCAGGTCCCTCTCGTAATCCATAATGGCGTGTGTACCCTCGGCTGGT
TGTACGTGGGCGGGTTACCCTGGGGGTGTGGGTGGATGACGGGTGGGCCCGGAGGAGGTCCGGCCC
CGCGCGTCATCGCGGGCGGGGTGTAGCGGGTGCGAAAAGGAGGCGATCGGTACGAAAATTCAAAT
TAGGAGGTGGGGGGCGGGGCCCTTGGAGAATAAGCGGAATCGCAGATATGCCCCTGACTTGGCTTG
GCTCCTCTTCTTCTTATCCCTTGTCCTCGCAACCCCGCTTCCTTCTCTCCTCTCCTCTTCTCTTCT
CTTCTCTGGTGGTGTGGGTGTGTCCCTGTCTCCCCTCTCCTTCCTCCTCTCCTTTCCCCTCCTCTC
TTCCCCCCTCTCACAAGAGAGAGAGCGCCAGACTCTCCCCAGGTGAGGTGAGACCAGTCTTTTTGC
TCGATTCGACGCGCCTTTCACGCCGCCTCGCGCGGATCTGACCGCTTCCCTCGCCCTTCTCGCAGG
ATTCAGCCATTTAAATCAACTAGGGATATCACAAGTTTGTACAAAAAAGCAGGCTTAAACAATGTC
AGGGGTTTGGGTGTTCAAGAACGGGGTGGTGAGATTGGTGGAGAAGCAGCAGGCGACGGCGGGGAC
GGCGGTGGCGGGAGGGAGGAGGAAGGCGCTGGTGCACACGCCGAGCGGGCAGGTGGTGTCGTCGTA
CGCGGCGCTGGAGGCGCGGCTGACGGCGCTCGGGTGGGAGCGCTACTACGAGGACCCCTCCCTCTT
CCAGTTCCACAAGCGTGGCTCCCTCGACCTCATCTCCCTCCCCGCCGACTTCTCCGCCTTCTCCTC
CGTCCACATGTACGACATCGTCGTCAAGAACCGCGACTCCTTCCGCGTCGTCGACGCCTAAAT

MEGVGARQRRNPLIPRP*NGSKR*HLQHQHQPNAAEKKTAATSNYFSIEAFLVLVF<u>LT</u>

<u>MSLLILPLVLPPLPPPPSLLLLLPVCLLILLVVLAFMPT</u>DVRSMASSYL

FIGURE 11

CLUSTAL W (1.83) multiple sequence alignment

```
------------------------------------------------------------
------------------------------------------------------------
------------MIREISNLQKD-----IINIQDS-YSNNRVMDV-GRNNR---KNMSFR
------------MIREFSSLQND-----IINIQEH-YSLNNNMDVRGDHNR---KNTSFR
------------MSIEQPEADSRLSEGPLINLQDR--YLSGIMEARGRRNSAPLQVERKN
------------MNSDNSESRQRLSKG-IINLQDR--YPTSIMD-RG--------VRKI
----------MNMDMESSEAKLRSSKG-FINLEEHQQYFNNIME--G-------------
-----------------------------------ME--G-------------------
------------------------------MDSQFGALERG----GSRQRR------SP
------------------------------MDSQFGAMDRG----GSRQRS------SP
---------------------------------MEGV----GARQRR------NP
------------------------------MASRSSAMEGG----AAIQR---------
------------------------------MASRSSALEGGG---AAIQR---------
-----------------------------------MEGG----GQIQR---------
-----------------------------------MEGG----GQIQR---------
---------------------------MLLEHLMITMEEQMFREQQMQRG------GR
MYLLSPRNGDEEDEQEEIQELISDDEPPNLKLASCATAASSSSSSGSDMEKGRGKACGGG

------------MVR---------------------CFSLGSVLILIALAASMVVLPL
----------MIMVAS------KEKTNSG--------GCMFRYSVLILSLLALSILVLPL
-SSPE--KSKQELRRSFSAQK--RMMIPA--------NYFSLESLFLLVGLTASLLILPL
GSAPAPIMGKQELFRTLSSQNSPRRLISA--------SYFSLESMVVLVGLTASLLILPL
PTPPMAEGKKMEYNRTPLSRENSRRLIPA--------SYFSLESLLLLICLTASLLILPL
ATPPVEK-RKVEYHRS-YSQGASRKLFSA--------SYFTLESLLLLVCLTASLLILPL
--------NKMEHKRS-FTQGHGKKMLSM--------NYFSLESIILLLGLTASLLLLPL
--------NKMEHKRS-FTQGHGKKMLSM--------NYFSLESIILLLGLTASLLLLPL
VLARPNTTKRHIQQQ--RANAADKKVVMP--------NYFSIEAFFVLACLTVSLLILPL
VLARPNTAKRQMQQQ--RANAADKKVVIP--------NYFGVEAFFVLACLTVSLLILPL
LIPRPNGSKRHLQHQH-QPNAAEKKTAATS-------NYFSIEAFLVLVFLTMSLLILPL
---RN-AVKRHLQQRQQEADFLDKKVIAS--------TYFSIGAFLVLACLTVSLLILPL
---RNNAVKRHLQQRQQEADFHDKKVIAS--------TYFSIGAFLVLACLTFSLLILPL
---RNNAVKRHLQQRQQEADFLDKKVIAS--------TYFSIEAFLVLACLTVSLLILPL
---RNNAVKRHLQQRQQEADFLDKKVIAS--------TYFSIEAFLVLACLTVSLLILPL
HHQHHTTREQEQQQKQQQRRLMNNATNGGGGDGGSRCYFSTEAILVLACVTVSLLVLPL
STAPPPPPSSSGKSGGGGSNIREAAASGGGGGVWGKYFSVESLLLLVCVTASLVILPL
                      :    :..:*  ::  *:::***
```

FIGURE 12

```
MLPPLPPPPLALLFFPVGIMAALVVLAFSPSENV----KNVVV----------------
VMPPLPPPPLLLLLVPVFIMLLLFFIAFSPSKKV----PNKAS----------------
VLPPLPPPPFMLLLVPIGIMVLLVVLAFMPSSHSNANTDVTCN----------------
ILPPLPPPPFMLLLIPIGIMVLLMVLAFMPSSNS-KHVSSSST----------------
ILPPLPPPPFMLLLLPIGILAVLMILAFMPSNVR----DLTYT----------------
VLPPLPPPPFLLLLVPIXILAVLLVLAFMPSNVR----DITST----------------
MLPPLPPPPFMLLLVPIFILVVLMILAFMPSNVR----NVTCS----------------
MLPPLPPPPFMLLLVPIFILVVLMILAFMPSNVR----NVTCS----------------
VLPPLPPPPSLLLFVPVCLLILLMVLAFMPTDMR----SMATS----------------
VLPPLPPPPSLLLLLPVCLLILLMVLAFMPTDVR----SMATS----------------
VLPPLPPPPSLLLLLPVCLLILLVVLAFMPTDVR----SMASS----------------
XXXXXXXXXXLLWLPVCLLVLLVVLAFMPTDVR----SMASS----------------
VLPPLPPPPSLLWLPVCLLVLLVVLAFMPTDVR----SVAAS----------------
VLPXLPAPASLLLWLPVWLLELLIVLAFMPTDVR----SMASS----------------
VLPPLPPPPSLLLWLPVCLLILLIVLAFMPTDVR----SMASS----------------
ILPPLPPPPTLLLLLPVCLLALLVVLAFMPTDMR----TMASS----------------
VLPPLPPPPSMLMLVPVAMLVLLLALAFMPTTTS----SSSSAGGGGGGGRNGATTGHAP
        *: .*: ::   *. :** *:

YSSSSSGIANSKR
FVS----------
FM-----------
FM-----------
YV-----------
YV-----------
YL-----------
YL-----------
YL-----------
YL-----------
YL-----------
YL-----------
YL-----------
YL-----------
YL-----------
YL-----------
YL-----------
YL-----------
:
```

FIGURE 12 (continued)

SEQ ID NO: 168, OsSYR coding sequence
ATGGAAGGTGTAGGTGCTAGGCAGAGGAGGAACCCTCTGATACCCAGACCAAACGGTTCAAAGAGG
CATCTGCAGCATCAGCATCAGCCAAATGCTGCCGAGAAGAAGACCGCCGCGACATCGAATTACTTC
AGTATCGAGGCGTTCCTCGTGCTCGTCTTCCTCACCATGTCATTGCTCATACTTCCATTGGTGCTT
CCCCCATTGCCTCCGCCGCCATCGCTGCTGCTGCTGCTGCCAGTCTGCCTGCTCATCCTGCTGGTT
GTGCTGGCCTTCATGCCAACGGATGTGCGGAGCATGGCTTCCTCTTACTTGTAAATACATCTCCTA
GGGGAATTTATTTTTGTTTTTGA

SEQ ID NO: 169, OsSYR deduced protein sequence
MEGVGARQRRNPLIPRPNGSKRHLQHQHQPNAAEKKTAATSNYFSIEAFLVLVFLTMSLLILPLVL
PPLPPPPSLLLLLPVCLLILLVVLAFMPTDVRSMASSYL

SEQ ID NO: 170, prm08170
GGGGACAAGTTTGTACAAAAAAGCAGGCTTAAACAATGGAAGGTGTAGGTGCTAGG

SEQ ID NO: 171, prm08171
GGGGACCACTTTGTACAAGAAAGCTGGGTCAAAAACAAAAATAAATTCCCC

SEQ ID NO: 172, rice GOS2 promoter sequence
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTCCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTTCGATCCATATCTTCCGGTCGAGTTCTTGG
TCGATCTCTTCCCTCCTCCACCTCCTCCTCACAGGGTATGTGCCCTTCGGTTGTTCTTGGATTTAT
TGTTCTAGGTTGTGTAGTACGGGCGTTGATGTTAGGAAAGGGGATCTGTATCTGTGATGATTCCTG
TTCTTGGATTTGGGATAGAGGGGTTCTTGATGTTGCATGTTATCGGTCGGTTTGATTAGTAGTAT
GGTTTTCAATCGTCTGGAGAGCTCTATGGAAATGAAATGGTTTAGGGTACGGAATCTTGCGATTTT
GTGAGTACCTTTTGTTTGAGGTAAAATCAGAGCACCGGTGATTTTGCTTGGTGTAATAAAAGTACG
GTTGTTTGGTCCTCGATTCTGGTAGTGATGCTTCTCGATTTGACGAAGCTATCCTTTGTTTATTCC
CTATTGAACAAAAATAATCCAACTTTGAAGACGGTCCCGTTGATGAGATTGAATGATTGATTCTTA
AGCCTGTCCAAAATTTCGCAGCTGGCTTGTTTAGATACAGTAGTCCCCATCACGAAATTCATGGAA
ACAGTTATAATCCTCAGGAACAGGGGATTCCCTGTTCTTCCGATTTGCTTTAGTCCCAGAATTTTT
TTTCCCAAATATCTTAAAAAGTCACTTTCTGGTTCAGTTCAATGAATTGATTGCTACAAATAATGC
TTTTATAGCGTTATCCTAGCTGTAGTTCAGTTAATAGGTAATACCCCTATAGTTTAGTCAGGAGAA
GAACTTATCCGATTTCTGATCTCCATTTTTAATTATATGAAATGAACTGTAGCATAAGCAGTATTC

FIGURE 14

```
ATTTGGATTATTTTTTTTATTAGCTCTCACCCCTTCATTATTCTGAGCTGAAAGTCTGGCATGAAC
TGTCCTCAATTTTGTTTTCAAATTCACATCGATTATCTATGCATTATCCTCTTGTATCTACCTGTA
GAAGTTTCTTTTTGGTTATTCCTTGACTGCTTGATTACAGAAAGAAATTTATGAAGCTGTAATCGG
GATAGTTATACTGCTTGTTCTTATGATTCATTTCCTTTGTGCAGTTCTTGGTGTAGCTTGCCACTT
TCACCAGCAAAGTTC
```

SEQ ID NO: 173, conserved motif 1a
YFS

SEQ ID NO: 174, conserved motif 1b
YFT

SEQ ID NO: 175, conserved motif 1c
YFG

SEQ ID NO: 176, conserved motif 1d
YLG

SEQ ID NO: 177, conserved motif 2
(V/A/I)LAFMP(T/S)

SEQ ID NO: 178, conserved motif 3
(S/P)YL

SEQ ID NO: 179, rice SYR homologue 1 (XP_472637), encoded by SEQ ID NO: 27
MYLLSPRNGDEEDEQEEIQELISDDEPPNLKLASCATAASSSSSSGSDMEKGRGKACGGGSTAPPP
PPPSSSGKSGGGGGSNIREAAASGGGGGVWGKYFSVESLLLLVCVTASLVILPLVLPPLPPPPSML
MLVPVAMLVLLLALAFMPTTTSSSSSAGGGGGGRNGATTGHAPYL

SEQ ID NO: 180, rice SYR homologue 2, deduced protein sequence (AP008218)
MLLEHLMITMEEQMFREQQMQRGGRHHQHHTTREQEQQQKQQQRRRLMNNATNGGGGDGGSRCYFS
TEAILVLACVTVSLLVLPLILPPLPPPPTLLLLLPVCLLALLVVLAFMPTDMRTMASSYL

SEQ ID NO: 181, corn SYR homologue (AY110705), encoded by SEQ ID NO: 28
MASRSSAMEGGAAIQRRNAVKRHLQQRQQEADFLDKKVIASTYFSIGAFLVLACLTVSLLILPLXX
XXXXXXXXXLLWLPVCLLVLLVVLAFMPTDVRSMASSYL

SEQ ID NO: 182, wheat SYR homologue, deduced protein sequence (CK211328)
MDSQFGALERGGSRQRRSPVLARPNTTKRHIQQQRANAADKKVVMPNYFSIEAFFVLACLTVSLLI
LPLVLPPLPPPPSLLLFVPVCLLILLMVLAFMPTDMRSMATSYL

SEQ ID NO: 183, barley SYR homologue (CB871444), encoded by SEQ ID NO: 36
MDSQFGAMDRGGSRQRSSPVLARPNTAKRQMQQQRANAADKKVVIPNYFGVEAFFVLACLTVSLLI
LPLVLPPLPPPPSLLLLLPVCLLILLMVLAFMPTDVRSMATSYL

FIGURE 14 (continued)

SEQ ID NO: 184, sugar cane SYR homologue 1 encoded by SEQ ID NO: 37 (CA165713)
MEGGGQIQRRNNAVKRHLQQRQQEADFLDKKVIASTYFSIEAFLVLACLTVSLLILPLVLPXLPAP
ASLLLWLPVWLLELLIVLAFMPTDVRSMASSYL SEQ ID NO: 185, sugar cane SYR homologue 2 encoded by SEQ ID NO: 38(CA242805)
MEGGGQIQRRNNAVKRHLQQRQQEADFLDKKVIASTYFSIEAFLVLACLTVSLLILPLVLPPLPPP
PSLLLWLPVCLLILLIVLAFMPTDVRSMASSYL SEQ ID NO: 186, sorghum SYR homologue, encoded by SEQ ID NO: 39 (CX611532)
MASRSSALEGGGAAIQRRNNAVKRHLQQRQQEADFHDKKVIASTYFSIGAFLVLACLTFSLLILPL
VLPPLPPPPSLLLWLPVCLLVLLVVLAFMPTDVRSVAASYL SEQ ID NO: 187, Arabidopsis thaliana SYR homologue 1, encoded by SEQ ID NO: 40 (NM_115853)
MIREISNLQKDIINIQDSYSNNRVMDVGRNNRKNMSFRSSPEKSKQELRRSFSAQKRMMIPANYFS
LESLFLLVGLTASLLILPLVLPPLPPPPFMLLLVPIGIMVLLVVLAFMPSSHSNANTDVTCNFM SEQ ID NO: 188, Arabidopsis thaliana SYR homologue 2, encoded by SEQ ID NO: 41 (NM_180078)
MIREFSSLQNDIINIQEHYSLNNNMDVRGDHNRKNTSFRGSAPAPIMGKQELFRTLSSQNSPRRLI
SASYFSLESMVVLVGLTASLLILPLILPPLPPPPFMLLIPIGIMVLLMVLAFMPSSNSKHVSSSS
TFM SEQ ID NO: 189, grape SYR homologue (CF404276), encoded by SEQ ID NO: 29
MSIEQPEADSRLSEGPLINLQDRYLSGIMEARGRRNSAPLQVERKNPTPPMAEGKKMEYNRTPLSR
ENSRRLIPASYFSLESLLLLICLTASLLILPLILPPLPPPPFMLLLLPIGILAVLMILAFMPSNVR
DLTYTYV SEQ ID NO: 190, citrus SYR homologue (CF830612), encoded by SEQ ID NO: 30
MNSDNSESRQRLSKGIINLQDRYPTSIMDRGVRKIATPPVEKRKVEYHRSYSQGASRKLFSASYFT
LESLLLLVCLTASLLILPLVLPPLPPPPFLLLLVPIXILAVLLVLAFMPSNVRDITSTYV SEQ ID NO: 191, tomato SYR homologue 1 (AI774560), encoded by SEQ ID NO: 32
MNMDMESSEAKLRSSKGFINLEEHQQYFNNIMEGNKMEHKRSFTQGHGKKMLSMNYFSLESIILLL
GLTASLLLLPLMLPPLPPPPFMLLLVPIFILVVLMILAFMPSNVRNVTCSYL SEQ ID NO: 192, tomato SYR homologue 2, partial sequence (BG125370), encoded by SEQ ID NO: 31
MEGNKMEHKRSFTQGHGKKMLSMNYFSLESIILLLGLTASLLLLPLMLPPLPPPPFMLLLVPIFIL
VVLMILAFMPSNVRNVTCSYL FIGURE 14 (continued)

SEQ ID NO: 193, Arabidopsis thaliana ARGOS protein (AY305869), encoded by SEQ ID NO: 42
MDVGRNNRKNMSFRSSPEKSKQELRRSFSAQKRMMIPANYFSLESLFLLVGLTASLLILPLVLPPL
PPPPFMLLLVPIGIMVLLVVLAFMPSSHSNANTDVTCNFM

SEQ ID NO: 194, Oryza sativa SYR homologue, mRNA, (XM_472637), encoding protein of SEQ ID NO: 12
ATGTACTTGTTGAGCCCAAGAAATGGCGACGAGGAGGACGAACAGGAGGAAATCCAGGAGCTGATC
AGCGACGACGAGCCGCCCAATCTCAAGTTGGCATCCTGCGCCACTGCAGCCAGCAGCAGCAGCAGC
AGCGGCAGCGACATGGAGAAGGGAAGAGGTAAAGCCTGCGGCGGCGGGAGTACGGCGCCGCCGCCG
CCGCCGCCGTCGTCGTCAGGTAAATCCGGCGGCGGCGGCGGCAGCAATATCAGGGAGGCGGCGGCT
AGCGGCGGCGGCGGCGGCGTGTGGGGCAAGTACTTCTCGGTGGAGTCGCTGCTCCTGCTGGTGTGC
GTGACGGCGTCGCTGGTGATCCTCCCGCTCGTGCTGCCGCCGCTGCCCCCGCCGCCGTCGATGCTG
ATGCTGGTGCCGGTGGCGATGCTGGTGCTGCTGCTGGCGCTGGCGTTCATGCCGACGACGACGTCG
TCGTCGTCGTCCGCCGGCGGCGGCGGCGGCGGCGGCCGCAATGGGGCGACGACGGGACATGCTCCC
TACTTGTAG

SEQ ID NO: 195, corn SYR homologue, mRNA (AY110705), encoding protein of SEQ ID NO: 14
TTCACATTACACTCATGACTCGTCTTAGGACGAATCCTGCAGCTGCAAAACACAGAAAATCTGGCC
AAGACCTATTTATCTATTTACAGGTAAGAGGAGGCCATGCTGCGCACATCTGTCGGCATGAAGGCC
AGTACAACCAGCAAGACGAGCAGGCAGACCGGCAGCCACAGCAGNNNNNNNNNNNNNNNNNNNNNN
NNNNNNNNNNCCAGCGGCAGTATCAGCAGCGAGACGGTGAGGCAGGCGAGCACGAGGAATGCCCCG
ATGCTGAAGTAGGTGGACGCGATGACCTTCTTGTCGAGGAAATCCGCCTCCTGCTGACGCTGCTGC
AGATGCCGCTTCACGGCATTCCTCCTTTGTATTGCCGCCCCTCCTTCCATCGCGCTAGATCGGCTT
GCCATGTGTTCTTTGGTGTAGGCGGAGGTGGAGACCAGTCGCAGTGAGTGGTTGCCAAAGTAAGCA
AGAAGTGAAAGGCGGTGTAGAACCGCCTTGNGTTTTCTGAACGTTTTGTAATCAGATCTGAGCTCG
GGTGGTCGAA

SEQ ID NO: 196, Vitis vinifera cDNA clone CSECS024D03 3' mRNA sequence (CF404276, reverse complement), encodes SEQ ID NO: 22
TACTTTGAACCGGTTGGAACTTGGTGACCGGTAAAGGAGAAATTTAAATGAGTATTGAGCAGCCTG
AAGCAGATTCAAGACTGTCTGAAGGACCTTTGATCAATCTGCAAGATCGATATTTGAGTGGCATCA
TGGAAGCGAGAGGAAGGAGGAACTCTGCTCCTCTGCAAGTTGAGAGGAAAAACCCTACTCCTCCTA
TGGCCGAAGGAAAGAAGATGGAATATAATAGAACTCCCCTCTCACGAGAGAACAGCAGGAGACTGA
TCCCAGCAAGCTATTTCAGCTTGGAGTCATTGCTTTTGCTCATCTGTCTCACGGCTTCATTGCTGA
TCCTTCCCCTGATACTACCACCATTGCCACCCCCTCCTTTCATGCTGCTTCTGCTCCCCATTGGCA
TTCTAGCAGTGCTTATGATCTTGGCTTTCATGCCTTCTAATGTCAGAGATTTGACTTATACATATG
TGTAAATGGTGGTGTTCAAAAGTGCACCTCTTCTCATCATACAATTTTTGTTATTTGTCTTGATAT
TCAGATGAAAATCAGTTATTTTATTTCTTGATTAAAAAAAAAAAAAAAAA

SEQ ID NO: 197, Citrus reticulata cDNA clone CR_CEa05B13, mRNA sequence (CF830612), encoding SEQ ID NO: 23 (nt 313-693)
AGGGTTTCTTCAAAGATAGGTAGCCATTTGCACATTTGAATCTGCTTGTTGGATATTGTCAAGGAG
GCTGTTGGAATTAGGCCACATTTCAGAATCTGGTTTCATCCTGGATCGCTGGGCATTTGAAGGCAT
TTTGTGATCATCGCTGTTTAAAATTTGGCCGCATATTAGAATCTGGGTTCTCATCGGTTTTCCGTA
CATTTACCTTGACCACATTTTGATATCTGGGTTGAGCTGCATTTTAGCCTTCGTATTTAAAAGGAC
TTGATCTAATCTGGGGTCTTGGTGAGCCGGGGCAACTGATCATAGTAAATGAATTCTGATAATTCT FIGURE 14 (continued)

GAGTCGAGACAGAGACTATCAAAGGGCATTATAAACTTGCAAGATCGATATCCGACCAGCATTATG
GATCGTGGTGTAAGAAAAATTGCAACTCCTCCGGTCGAGAAGAGGAAAGTTGAGTATCACCGAAGT
TACTCGCAAGGGGCATCCAGAAAACTGTTTTCGGCAAGCTATTTCACCCTGGAATCATTGCTTTTG
CTCGTATGTCTGACGGCCTCATTGCTGATCCTGCCATTGGTGCTTCCGCCCTTGCCGCCCCCGCCA
TTCCTGCTGCTTCTGGTTCCTATANGTATTCTAGCCGTGCTTTTGGTCTTGGCATTCATGCCTTCT
AATGTAAGAGATATAACTTCCACGTACGTGTAAATGGTGTTGCT

SEQ ID NO: 198, Lycopersicon esculentum cDNA clone cTOF8M10 5'
sequence, partial mRNA sequence (BG125370)encoding SEQ ID NO: 25
GAAAAAAATGTATTTAATCATTATGTAAAAAACAAGTGAATCTACTTTGATATTTCTTCTAAATT
AAACCACACAATTAAAGATATGAGCAAGTCACATTCCTAACATTAGAAGGCATAAAAGCTAAGATC
ATAAGAACAACAAGAATGAAAATTGGGACTAACAACAACATAAAAGGTGGTGGTGGCAATGGTGGA
AGCATCAATGGCAAAAGTAACAAAGATGCTGTAAGACCAAGTAACAAAATAATTGACTCTAAGCTA
AAATAATTCATTGACAACATTTTCTTGCCATGTCCTTGTGTAAATGATCTCTTATGCTCCATCTTA
TTGCCTTCCATAATGTTGTTGAAATATTGTTGATGTTCCTCCAAATTAATAA

SEQ ID NO: 199, Lycopersicon esculentum cDNA clone cTOF8M10 5'
sequence, mRNA sequence (AI774560), encoding SEQ ID NO: 24
TTTGTTAAAGATTGGCACATTTTCAAGTTCAGTATTCATTCGATTTTTGATATCTACATAAAAAAA
AAGTGTCCTGGTACTACTCAATATTCCTCAGAACGACTTCATATTCAGGTCTCGAATTCAAAACCT
CACATCAAGATTCTTAGGAAATTTCAAGATTGGTTGAAAAACTCATATCCTTCTCTAAGTTTCAAG
ATTGGTTCCAAATTAAAACTCGAGACTTCTGAGTAAGAGCGTACGACTAGTAATGAACATGGACAT
GGAATCATCAGAGGCAAAATTGAGATCATCAAAAGGGTTTATTAATTTGGAGGAACATCAACAATA
TTTCAACAACATTATGGAAGGCAATAAGATGGAGCATAAGAGATCATTTACACAAGGACATGGCAA
GAAAATGTTGTCAATGAATTATTTTAGCTTAGAGTCAATTATTTTGTTACTTGGTCTTACAGCATC
TTTGTTACTTTTGCCATTGATGCTTCCACCATTGCCACCACCACCTTTTATGTTGTTGTTAGTCCC
AATTTTCATTCTTGTTGTTCTTATGATCTTAGCTTTTATGCCTTCTAATGTTAGGAATGTGACTTG
CTCATATCTTTAATTGTGTGGTTTAATTTA

SEQ ID NO: 200, High mobility group protein promoter
CATGCGGCTAATGTAGATGCTCACTGCGCTAGTAGTAAGGTACTCCAGTACATTATGGAATATACA
AAGCTGTAATACTCGTATCAGCAAGAGAGAGGCACACAAGTTGTAGCAGTAGCACAGGATTAGAAA
AACGGGACGACAAATAGTAATGGAAAAACAAAAAAAAACAAGGAAACACATGGCAATATAAATGGA
GAAATCACAAGAGGAACAGAATCCGGGCAATACGCTGCGAAAGTACTCGTACGTAAAAAAAAGAGG
CGCATTCATGTGTGGACAGCGTGCAGCAGAAGCAGGGATTTGAAACCACTCAAATCCACCACTGCA
AACCTTCAAACGAGGCCATGGTTTGAAGCATAGAAAGCACAGGTAAGAAGCACAACGCCCTCGCTC
TCCACCCTCCCACCCAATCGCGACGCACCTCGCGGATCGGTGACGTGGCCTCGCCCCCCAAAAATA
TCCCGCGGCGTGAAGCTGACACCCCGGGCCCACCCACCTGTCACGTTGGCACATGTTGGTTATGGT
TCCCGGCCGCACCAAAATATCAACGCGGCGCGGCCCAAAATTTCCAAAATCCCGCCCAAGCCCCTG
GCGCGTGCCGCTCTTCCACCCAGGTCCCTCTCGTAATCCATAATGGCGTGTGTACCCTCGGCTGGT
TGTACGTGGGCGGGTTACCCTGGGGGTGTGGGTGGATGACGGGTGGGCCCGGAGGAGGTCCGGCCC
CGCGCGTCATCGCGGGCGGGGTGTAGCGGGTGCGAAAAGGAGGCGATCGGTACGAAAATTCAAAT
TAGGAGGTGGGGGCGGGGCCCTTGGAGAATAAGCGGAATCGCAGATATGCCCCTGACTTGGCTTG
GCTCCTCTTCTTCTTATCCCTTGTCCTCGCAACCCCGCTTCCTTCTCCTCTCCTCTTCTCTTCT
CTTCTCTGGTGGTGTGGGTGTGTCCCTGTCTCCCCTCTCCTTCCTCCTCTCCTTTCCCCTCCTCTC
TTCCCCCCTCTCACAAGAGAGAGAGCGCCAGACTCTCCCCAGGTGAGGTGAGACCAGTCTTTTTGC
TCGATTCGACGCGCCTTTCACGCCGCCTCGCGCGGATCTGACCGCTTCCCTCGCCCTTCTCGCAGG
ATTCAGCC SEQ ID NO: 201, Medicago sativa
MVRCFSLGSVLILIALAASMVVLPLMLPPLPPPPLALLFFPVGIMAALVVLAFSPSENVKNVVVYS
SSSSGIANSKR SEQ ID NO: 202, Medicago sativa
MIMVASKEKTNSGGCMFRYSVLILSLLALSILVLPLVMPPLPPPPLLLLLVPVFIMLLLFFIAFSP
SKKVPNKASFVS SEQ ID NO: 203, CB871444 HC03O01y CH Hordeum vulgare cDNA clone HC03O01 3-PRIME, reverse complement mRNA sequence encoding SEQ ID NO: 16

CTTCCGAGAAAGATGCTTCATATTGCACTCATCTTATGCCAACACACAATCAGAAACAAAAACCAC
GCAGCAAGCCTATTTACAAGTAAGAGGTGGCCATGCTCCGCACATCAGTCGGCATGAAGGCCAGCA
CCATCAACAGGATGAGCAAGCAGACCGGCAAGAGCAGCAGTAGCGATGGCGGTGGGGGCAACGGAG
GCAGCACCAATGGCAGTATGAGCAATGAAACGGTGAGGCAGGCGAGCACGAAGAACGCTTCGACGC
CGAAGTAGTTCGGTATGACAACCTTCTTGTCAGCAGCATTTGCCCTCTGCTGCTGCATTTGCCTCT
TTGCAGTATTTGGTCTGGCTAACACAGGGCTGCTCCTCTGCCTACTACCGCCTCTGTCCATTGCAC
CGAACTGGCTATCCATCTATTCTTTGGTGAGTGCAGATCAGCGGCTATCCAGGAACTGAGATGAAT
AAGAACTTGTGGAATCTGAAGGTTTTTAACAGATCTGAAGTCTTTGTGAGTCCGTGACTGAACTGC
AGATCATCTGCTGTGGAAGAACTGCACCGCAAGTGGCAATACCTTCGATCCTGAAACTTGCATTTT
GGTGATGCCCGTACCACGC

SEQ ID NO: 204, CA165713 SCUTRZ3071B09.g RZ3 Saccharum officinarum cDNA clone SCUTRZ3071B09 5', mRNA sequence, encoding SEQ ID NO: 17
GGAGAACGTGCTTGTTCAGGTGGTTCAACAGTGCGGACCAGAGAACAATGCGAGGTTCAGGATTAA
AGGTATTCTGGCTTCAGAGGCAGTTCTTCCAAAGCAAGTGACAGGCGATTCCATCACCGGAGCTAA
GATCTTATTACAACATTCAGAAACACAGGAGTCCTCCCACCGCCTTTCACTTCTTGCTTACTTCTG
CAACCACTCGCCGTGACTGATCTCCACGCACACCAAAGAACACAACACGTGGCAAGCCGATCTAGC
GCGATGGAAGGAGGGGGGCAAATACAGAGGAGGAATAATGCCGTGAAGCGGCACCTGCAGCAGCGG
CAGCAGGAGGCGGATTTCCTCGACAAGAAGGTCATCGCGTCCACCTATTTCAGCATCGAGGCGTTC
CTCGTGCTCGCCTGCCTCACCGTCTCGCTGCTGATACTGCCGCTTGTGCTGCCGNCGCTGCCGGCG
CCGGCGTCGCTGCTGCTGTGGCTGCCGGTCTGGCTGCTCGAACTGCTGATTGTGCTTGCCTTCATG
CCGACAGATGTGCGCAGCATGGCCTCCTCTTACTTGTAAAAAAATAGATAAATAGGCCACCTTTGG
CAATTTTCTGGGGTTTGGAGGTG SEQ ID NO: 205, reverse complement of CA242805 SCSFFL3090G07.b Saccharum officinarum FL3 Saccharum officinarum cDNA clone SCSFFL3090G07 3', mRNA sequence, encoding SEQ ID NO: 18
GATTTTTCCAAGCCAGTGACCGGCGATTCATCAACCGGAGCTGAGATCTTATACAACATTCAGAA
ACACAGGAGTCCTCGCACCGCTTTCCACTCTTGGCTAATTTTGCAACCACTCGCCGTGACTGATCT
CCACGCACACCAAAGAACACAACACGTGGCAACCCGATCTAGCGCGATGGAAGGAGGGGGGCAAAT
ACAGAGGAGGAATAATGCCGTGAAGCGGCACCTGCAGCAGCGGCAGCAGGAGGCGGATTTCCTCGA
CAAGAAGGTCATCGCGTCCACCTATTTCAGCATCGAGGCGTTCCTCGTGCTCGCCTGCCTCACCGT
CTCGCTGCTGATACTGCCGCTGGTGCTGCCGCCGCTGCCGCCGCCGTCGCTGCTGCTGTGGCT
GCCGGTCTGCCTGCTCATCCTGCTGATTGTGCTGGCCTTCATGCCGACAGATGTGCGCAGCATGGC
CTCCTCTTACTTGTAATAAATAGATAAATAGGCCACCTTGGTCAATATTCTGTGATTTGGAGGTGA
TTCGTCCTGAGATGAGTCTCGATTGATGTCAGCTACTCCCAAGGGGAAATGCATGTAACACTTGGT
GGCCGACGGTGGCAAGATAATCATGCTACCATGTCAGTTAAACC FIGURE 14 (continued)

SEQ ID NO: 206, CX611532 ANR1_25_E08.b1_A002 Anaerobic roots
Sorghum bicolor cDNA clone ANR1_25_E08_A002 3', mRNA sequence
encoding SEQ ID NO: 19
GCTGTTGGTGTTGTTCTTGAGATCTCTTTCTTGATCTTGTGTGGGATTAAAGAGGGATTCTTGCCT
TCCTACGGGAGAAAGAGAAAAGGGGAAGAACGTGCTTGTTCCGGTGGTTCAACAGTGCGGAGACCC
GGAGAACAATGCGAGGTTCAGGATTAAAGGTGTTCTGGCTTCAGGTGCAGTTCTTCCAAAGCAGGT
GACAGGCGATTCGATCACCGGAGCTCAGATCTGACGAAAACAAAACACAGTCCTCCTCCCACCGCC
TTTCAGTTCTTGCTTACTTCTGCAACCACTCACTGCGACCGTACACCAAAGAACACTGCACATGGC
AAGCCGATCTAGCGCGCTGGAAGGAGGGGGGCAGCAATACAGCGGAGGAATAATGCCGTGAAGCG
GCACCTGCAGCAGCGGCAGCAGGAGGCGGATTTCCACGACAAGAAGGTCATCGCGTCCACCTACTT
CAGCATCGGCGCGTTCCTGGTGCTCGCCTGCCTCACCTTCTCGCTGCTCATCCTGCCGCTGGTGCT
GCCGCCGCTGCCGCCGCCGCCGTCGCTGCTGCTGTGGCTGCCGGTCTGCCTGCTCGTCCTGCTGGT
TGTGCTGGCCTTCATGCCGACAGATGTGCGCAGCGTGGCGGCCTCTTACTTGTAAATAGCCAGATA
AATAGGCCACCACCTTTGGCCAGTTTTCTGTGTTTTCGGGGGTGATTCGTCCTAAGATGAGTCATG
ATCGAGTGTAATGTGAAGCATCTTTTCCAGGGGTAGTAGATTTCAATGAAGT SEQ ID NO: 207, NM_115853.3| Arabidopsis thaliana unknown protein
(AT3G59900) mRNA, complete cds, encoding SEQ ID NO: 20
TTGTCTTCCTCATTTCCCTACTAGTACTTGTTTCACACAGTTTCTTGATCCAACCAAAACCAATAC
ACAAAGCTTCTCAAACTCCTTCACCTCAAAGCTTCTTCCTTTACATCTGAATCGTTGAGTTAACTC
GGATTTGTTCTGCATCCTCTGTTTCTGAATCGTGGGCCATCCTTATTTTGTCTCGAATTCTTCACC
AATTGCTTCGATCAAGCTGCATTGGTTAACCAGTTGCCCTAAAGATCAGATCTTTGAGCAAAATTT
TGTCACTGATCTTCTAAATCCAAACCAGACACAGCAAAACAACCTCTGTAGATGATTCGAGAAATC
TCAAACTTACAAAAGATATTATAAACATTCAAGACAGTTATTCGAACAACCGAGTCATGGACGTC
GGAAGAAACAACCGGAAAAACATGAGCTTTCGAAGTTCGCCGGAGAAAAGCAAGCAAGAGTTACGG
CGGAGTTTCTCGGCGCAGAAAAGGATGATGATCCCGGCGAATTATTTCAGTTTAGAGTCTCTGTTC
CTATTGGTTGGTCTAACGGCATCTCTGTTAATACTTCCGTTAGTTTTGCCGCCGTTACCTCCGCCT
CCGTTTATGCTGCTATTGGTTCCCATTGGGATTATGGTTTTACTCGTCGTTCTTGCCTTCATGCCT
TCTTCTCATTCTAATGCTAATACAGATGTAACTTGCAATTTCATGTAAATCTGAAATTTATTATAT
GATGAT SEQ ID NO: 208, NM_180078.2| Arabidopsis thaliana unknown protein
(AT2G44080) mRNA, complete cds, encoding SEQ ID NO: 21
CCCACTTTATTTCTTCTTCTCTGGTTTTCTTACCAAAAGAAACTTTCTTCGTCTTCCTCTGTATTT
AAGCTTTAACACCCTGTTTTTGGTTTCCAACGTTCAATCTTCATCTTCTTCTCGCTGAAGGTGTGT
TTGGCTCTAACGGTTTAAAGCTTTCTTGAAACACCAATTGAATCTTTTCTCTCTACCGGCAAAAAA
AAAAGATTAGTCCTTTTAGGTCTGGAAACGCCAAGATCACTCGTTCTAAACCTTAGATTTTGTCTG
CATTTCGGGATAATCATTTCATCGTCAGGGTTCTTCAACCAAACTACATTTACAGAAGAAGAAGAA
GAAGAAAGTTCGTTACTTTTTATGCGTTTGGATAAACAAACTCAAGTTTCTTCTTCATACATCGA
TCTGATTTTCCAGATCAAACTTCGAAAAGAGAAAAAGCCTTCTTTAAATGATTCGTGAGTTCTCCA
GTCTACAAAACGACATCATAAACATTCAAGAACATTATTCTCAACAACAACATGGACGTGAGAG
GAGATCATAACCGGAAAAACACGAGTTTTCGTGGTTCAGCTCCAGCTCCGATTATGGGGAAGCAAG
AATTGTTTCGGACATTGTCGTCGCAGAACAGTCCAAGGAGGCTAATATCAGCGAGTTACTTCAGTT
TAGAATCAATGGTTGTGCTTGTTGGTCTCACAGCATCTCTCTTGATCTTACCGTTGATTCTTCCAC
CATTGCCTCCTCCTCCTTTTATGCTGCTTTTGATTCCTATTGGGATTATGGTTTTGCTTATGGTTC
TTGCTTTCATGCCTTCTTCTAATTCCAAACATGTTTCTTCTTCTTCCACTTTTATGTAATAAACGT
TTCTTTAATTGAAGAAAGAAATCCTTAAACAAA FIGURE 14 (continued)

SEQ ID NO: 209, AY305869.1| Arabidopsis thaliana auxin-inducible protein (ARGOS) mRNA, complete cds, encoding SEQ ID NO: 26
TTGTCTTCCTCATTTCCCTACTAGTACTTGTTTCACACAGTTTCTTGATCCAACCAAAACCAATAC
ACAAAGCTTCTCAAACTCCTTCACCTCAAAGCTTCTTCCTTTACATCTGAATCGTTGAGTTAACTC
GGATTTGTTCTGCATCCTCTGTTTCTGAATCGTGGGCCATCCTTATTTGTCTCGAATTCTTCACC
AATTGCTTCGATCAAGCTGCATTGGTTAACCAGTTGCCCTAAAGATCAGATCTTTGAGCAAAATTT
TGTCACTGATCTTCTAAATCCAAACCAGACACAGCAAAACAACCTCTGTAGATGATTCGAGAAATC
TCAAACTTACAAAAGATATTATAAACATTCAAGACAGTTATTCGAACAACCGAGTCATGGACGTC
GGAAGAAACAACCGGAAAACATGAGCTTTCGAAGTTCGCCGGAGAAAAGCAAGCAAGAGTTACGG
CGGAGTTTCTCGGCGCAGAAAAGGATGATGATCCCGGCGAATTATTTCAGTTTAGAGTCTCTGTTC
CTATTGGTTGGTCTAACGGCATCTCTGTTAATACTTCCGTTAGTTTTGCCGCCGTTACCTCCGCCT
CCGTTTATGCTGCTATTGGTTCCCATTGGGATTATGGTTTTACTCGTCGTTCTTGCCTTCATGCCT
TCTTCTCATTCTAATGCTAATACAGATGTAACTTGCAATTTCATGTAAATCTGAAATTTATTATAT
GATGAT

SEQ ID NO: 210, HMG promoter, variant
CATGCGGCTAATGTAGATGCTCACTGCGCTAGTAGTAAGGTACTCCAGTACATTATGGAATATACA
AAGCTGTAATACTCGTATCAGCAAGAGAGAGGCACACAAGTTGTAGCAGTAGCACAGGATTAGAAA
AACGGGACGACAAATAGTAATGGAAAAACAAAAAAAAACAAGGAAACACATGGCAATATAAATGGA
GAAATCACAAGAGGAACAGAATCCGGGCAATACGCTGCGAAAGTACTCGTACGTAAAAAAAAGAGG
CGCATTCATGTGTGGACAGCGTGCAGCAGAAGCAGGGATTTGAAACCACTCAAATCCACCACTGCA
AACCTTCAAACGAGGCCATGGTTTGAAGCATAGAAAGCACAGGTAAGAAGCACAACGCCCTCGCTC
TCCACCCTCCCACCCAATCGCGACGCACCTCGCGGATCGGTGACGTGGCCTCGCCCCCAAAAATA
TCCCGCGGCGTGAAGCTGACACCCCGGGCCCACCCACCTGTCACGTTGGCACATGTTGGTTATGGT
TCCCGGCCGCACCAAAATATCAACGCGGCGCGGCCCAAAATTTCCAAAATCCCGCCCAAGCCCCTG
GCGCGTGCCGCTCTTCCACCCAGGTCCCTCTCGTAATCCATAATGGCGTGTGTACCCTCGGCTGGT
TGTACGTGGGCGGGTTACCCTGGGGGTGTGGGTGGATGACGGGTGGGCCCGGAGGAGGTCCGGCCC
CGCGCGTCATCGCGGGGCGGGGTGTAGCGGGTGCGAAAAGGAGGCGATCGGTACGAAAATTCAAAT
TAGGAGGTGGGGGGCGGGGCCCTTGGAGAATAAGCGGAATCGCAGATATGCCCCTGACTTGGCTTG
GCTCCTCTTCTTCTTATCCCTTGTCCTCGCAACCCCGCTTCCTTCTCTCCTCTCCTCTTCTCTTCT
CTTCTCTGGTGGTGTGGGTGTGTCCCTGTCTCCCCTCTCCTTCCTCCTCTCCTTTCCCCTCCTCTC
TTCCCCCCTCTCACAAGAGAGAGAGCGCCAGACTCTCCCCAGGTGAGGTGAGACCAGTCTTTTTGC
TCGATTCGACGCGCCTTTCACGCCGCCTCGCGCGGATCTGACCGCTTCCCTCGGCCTTCTCGCAGG
ATTCAGCC

SEQ ID NO: 211, GOS2 promoter variant
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTCACATACAAAAAAAAAAGAATT FIGURE 14 (continued)

```
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTTCTCCCATCTATAA
ATTCCTCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAAGGGGATCTGTATCTGTGATGATTCC
TGTTCTTGGATTTGGGATAGAGGGGTTCTTGATGTTGCATGTTATCGGTTCGGTTTGATTAGTAGT
ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA
AACAGTTATAATCCTCAGGAACAGGGGATTCCCTGTTCTTCCGATTTGCTTTAGTCCCAGAATTTT
TTTTCCCAAATATCTTAAAAAGTCACTTTCTGGTTCAGTTCAATGAATTGATTGCTACAAATAATG
CTTTTATAGCGTTATCCTAGCTGTAGTTCAGTTAATAGGTAATACCCCTATAGTTTAGTCAGGAGA
AGAACTTATCCGATTTCTGATCTCCATTTTTAATTATATGAAATGAACTGTAGCATAAGCAGTATT
CATTTGGATTATTTTTTTATTAGCTCTCACCCCTTCATTATTCTGAGCTGAAAGTCTGGCATGAA
CTGTCCTCAATTTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTC
```

FIGURE 14 (continued)

MDDHMGRRTVGGLLFTKGGSILLFREDSARHKATNCCTRHGCSSKHLAGKDKQTHRAA
TAAKEASETPRRSQIFRKPSTRTPQGSTATDNISRNAASSYSENDNRPRETPGRDLIA
RLKERVNASRKRSLNRENSPSSPNGLSATSSSSSRTVSRPSHRAASRIRKADEGANAG
AVNVRRDSSGDTRRNSDRDVDDFLLVEQAARDSTEGFISGFLARYRSNHQGLLSSLDD
SIEDANGYWRFNMEGSEELENYFIFNDRYRGMRMDIDGMSYEELLALGDRIGTVSTGL
SEDALSKCLDRSMYMATTSGTHEDCERKCSICQEEYSDGEEVGKMVCKHYYHFSCIK
NWLRQKNWCPICKSVALNTN

FIGURE 15

```
                 1                                                50
Glyma_ARKL2    (1) --------------------------------------------------
Glyma_ARKL1    (1) MSPWHEPDPYGLSKVRAKDTDLTSPHLIPSMQGQRGTVGSMPETLEFDCG
Horvu_ARKL3    (1) --------------------------------------------------
Horvu_ARKL2    (1) ---------------------------MQGQRNSVEQLADVFGFDHG
Horvu_ARKL1    (1) --------------------------------------------------
Zeama_ARKL2    (1) --------------------------------------------------
Zeama_ARKL1    (1) --------------------------------------------------
Orysa_ARKL9    (1) --------------------------------------------------
Orysa_ARKL8    (1) --------------------------------------------------
Orysa_ARKL7    (1) --------------------------------------------------
Orysa_ARKL6    (1) --------------------------------------------------
Orysa_ARKL5    (1) --------------------------------------------------
Orysa_ARKL4    (1) ------------------------------MHQHRITMLSSSETCHLG
Orysa_ARKL3    (1) --------------------------------------------------
Orysa_ARKL1    (1) --------------------------------------------------
Consensus      (1)
```

FIGURE 16

```
                       51                                              100
Glyma_ARKL2     (1)   ------------------------------------------------
Glyma_ARKL1    (51)   SASGNSTVDQQICWNNVNPAEN----------QIPDYILSPGDMNSSYG
Horvu_ARKL3     (1)   ------------------------------------------------
Horvu_ARKL2    (21)   SGSGNPVMDQQAYWNSMLGAAES---------QNLQGYEMNRGDGAIPYG
Horvu_ARKL1     (1)   ------------------------------------------------
Zeama_ARKL2     (1)   ------------------------------------------------
Zeama_ARKL1     (1)   ------------------------------------------------
Orysa_ARKL9     (1)   ------------------------------------------------
Orysa_ARKL8     (1)   ------------------------------------------------
Orysa_ARKL7     (1)   ------------------------------------------------
Orysa_ARKL6     (1)   ------------------------------------------------
Orysa_ARKL5     (1)   ------------------------------------------------
Orysa_ARKL4    (19)   SSSNNQAMDQQNLLPSNPTADEQNLLPNTLEDDDYPHYLLGSHEVEMPNG
Orysa_ARKL3     (1)   ------------------------------------------------
Orysa_ARKL1     (1)   ------------------------------------------------
  Consensus    (51)

101                                             150
Glyma_ARKL2     (1)   ------------------------------------------------
Glyma_ARKL1    (90)   NSIINREWQNLSGWSLGEPSSSNTPNEVNNNEQKRELGWSSTITAGALAG
Horvu_ARKL3     (1)   ------------------------------------------------
Horvu_ARKL2    (62)   -GEGHQDGQFLGFWGSGEASSSGNALNIGG------------------G
Horvu_ARKL1     (1)   ------------------------------------------------
Zeama_ARKL2     (1)   ------------------------------------------------
Zeama_ARKL1     (1)   ------------------------------------------------
Orysa_ARKL9     (1)   ------------------------------------------------
Orysa_ARKL8     (1)   ------------------------------------------------
Orysa_ARKL7     (1)   ------------------------------------------------
Orysa_ARKL6     (1)   ------------------------------------------------
Orysa_ARKL5     (1)   ------------------------------------------------
Orysa_ARKL4    (69)   -SVIGQQNTSLNLWDSAGSSSMGCVADHDSLFEAKREHFAPALSIR--AP
Orysa_ARKL3     (1)   ------------------------------------------------
Orysa_ARKL1     (1)   ------------------------------------------------
  Consensus   (101)

151                                             200
Glyma_ARKL2     (1)   ------------------------------------------------
Glyma_ARKL1   (140)   PRLEERRLEPANALSLDNVNTGP------MYTRSPNSRLMSQNLNLNAGL
Horvu_ARKL3     (1)   ------------------------------------------------
Horvu_ARKL2    (92)   LRIGERRLGAEHSLSLDNVDINLNASGHDLFGQSSNANATSQASQQNAGC
Horvu_ARKL1     (1)   -------MEEYLSRRSRTAIGFLRRGSGIN---RSPEETISQNTEVQGRT
Zeama_ARKL2     (1)   ------------------------------------------------
Zeama_ARKL1     (1)   ------------------------------------------------
Orysa_ARKL9     (1)   ------------------------------------------------
Orysa_ARKL8     (1)   ------------------------------------------------
Orysa_ARKL7     (1)   ---------------------------------------MAGHQYNNSQM
Orysa_ARKL6     (1)   ------------------------------------------------
Orysa_ARKL5     (1)   ---------------------------------------MARHHGNHSLL
Orysa_ARKL4   (116)   LIIGGRRHEGSSSLPSQSLNLDLN------------L---NQADQFDSED
Orysa_ARKL3     (1)   -------MEDYPSGRSKAAIGFLRRGGGFSSRNQSTEERTIQNYDPGIT
Orysa_ARKL1     (1)   ------------------------------------------------
  Consensus   (151)
```

FIGURE 16 (continued)

```
                     201                                              250
Glyma_ARKL2    (1)   --------------------------------------------------
Glyma_ARKL1  (184)   ADNGSDNSQHLELPNLNKSSGSANECIPPNVGSGSFLLPSGNNGFLVEDT
Horvu_ARKL3    (1)   --------------------------------------------------
Horvu_ARKL2  (142)   SRADTTAQATELRLHPYRTFGLDDEQPEPFPSLNAFEHPLGNFSLMPEDI
Horvu_ARKL1   (41)   SRVNPMKTRLVDNQERPRYLHGSYKYASSNVMSGSSSKFPKKFPLRKFGE
Zeama_ARKL2    (1)   --------------------------------------------------
Zeama_ARKL1    (1)   --------------------------------------------------
Orysa_ARKL9    (1)   --------------------------------------------------
Orysa_ARKL8    (1)   ------MLQRNMVWTHQVASPENQVQPESFYHGGAGSNLSNLSVQVAVGV
Orysa_ARKL7   (12)   SRMDHMDR---LNNEPPPFGQKLFMHPRSDPANGAGSSGYVGNTMRSNDL
Orysa_ARKL6    (1)   --------------------------------------------------
Orysa_ARKL5   (12)   PEMVQPNNE--QLNQPLPLGQKLFVHAGNDAALKIGPSYHGNVAIRSNDL
Orysa_ARKL4  (151)   VDMIQSNGQPGINAFPLNRGLSIPEHVLRHTNSSSATGNPSQVASFSDGM
Orysa_ARKL3   (44)   TRLNPMKTRLSDNQERPRYLRDSFRSSTSMAIHGSSS----KVPLRKFGD
Orysa_ARKL1    (1)   --------------------------------------------------
   Consensus (201)

251                                              300
Glyma_ARKL2    (1)   --------------------------------------------------
Glyma_ARKL1  (234)   DGRPGCSHDTRRVSCKRKAVEGNNGQSSDAGSSSYSQHTDGSAWHTIPTQ
Horvu_ARKL3    (1)   -------------------------------------------MDEHMGR
Horvu_ARKL2  (192)   DQRPGSSLDGRRLACKRKNIEGVHGQFSAGASTSFSHRNDNAFHSVPSSS
Horvu_ARKL1   (91)   EKRRQTLLEGADVAESSRRKSDVGCLEGS-KKTIVENQGSDAPQTETEGL
Zeama_ARKL2    (1)   --------------------------------------------------
Zeama_ARKL1    (1)   --------------------------------------------------
Orysa_ARKL9    (1)   --------------------------------------------------
Orysa_ARKL8   (45)   PGNTDFRSHYESINLQHQHVQNPYPHVGVASSSVFPSTMYNPCISTTAVD
Orysa_ARKL7   (59)   PSSSYAGQAYGQ--QNRAPIHASYSGHAPAGSSSGSYAPYNTQHMPASSY
Orysa_ARKL6    (1)   --------------------------------------------------
Orysa_ARKL5   (60)   PSSSRVAQYSGHRVKNTGTLHNSY-VHYPAGSSGG-HVSYNPQTEPVITY
Orysa_ARKL4  (201)   TGQEVNLFGGHRSSCKRKNIDGSLAESSANGSSRNNQRNNIILEPSPSSH
Orysa_ARKL3   (90)   EKRRQTLLAGVDIAESSSRNAGGKHLEGSNKRIVVDDRSSDVLHTETEGL
Orysa_ARKL1    (1)   -------------------------------------------MDDHMGR
   Consensus (251)

301                                              350
Glyma_ARKL2    (1)   --------------------------------------------------
Glyma_ARKL1  (284)   VNAGSSSRRS--------ISSEQVNARLGLGMGDGASENVPDSNIAGSSE
Horvu_ARKL3    (8)   RTVGGLLFTKGGSILLFREDS-SRRKAGACCPRNGCNGTRHSTDKGRPTP
Horvu_ARKL2  (242)   FNPAPGPNVSSHNFLLAPSSIEEQLPNYGTTTGMSSVSYNPPSGGNNSSG
Horvu_ARKL1  (140)   TAKDDELIAPDPEVSHSAGSSGIPAHTDGSLIRSASLSSETHRQKNKELN
Zeama_ARKL2    (1)   --------------------------------------------------
Zeama_ARKL1    (1)   --------------------------------------------------
Orysa_ARKL9    (1)   --------------------------------------------------
Orysa_ARKL8   (95)   RYVPPIQSFGLGNPLLLPLYHQLAQGSMDENGSSGNFCDSVREFIKRKNA
Orysa_ARKL7  (107)   PHGSEDNFIP---------SSHVDGRRVALKRRNPIIHPTDGFGVGNYYA
Orysa_ARKL6    (1)   --------------------------------------------------
Orysa_ARKL5  (108)   PHRSEGEFARG--------SSQIDNRTAAVKRKNPVIYPEYSINGDGYCA
Orysa_ARKL4  (251)   ESTSGLTAPAPTNHVFSYSPVEQLNQNTNMSANAMLSDHYSLYG-DHERE
Orysa_ARKL3  (140)   ATEQDQLIAPNAGVSDSASSSDISEHAVESLVRSAAPSSRTRRQKDKELN
Orysa_ARKL1    (8)   RTVGGLLFTKGGSILLFREDS-ARHKATNCCTRHGCS-SKHLAGKDKQT-
   Consensus (301)
```

FIGURE 16 (continued)

```
                     351                                              400
Glyma_ARKL2    (1)   ------------------------------------------------------
Glyma_ARKL1  (326)   SFHRNFRLRLNPSNPPNS--------------------------------VPPTA
Horvu_ARKL3   (57)   SHR--EAAATAAKEAAPTT-------------------------------RRSQPL
Horvu_ARKL2  (292)   NSQRSFRARTTTAQQVS---------------------------------PYGV
Horvu_ARKL1  (190)   LGRPGYSCSSSFSNQPTIP-------------------------------RIPTVG
Zeama_ARKL2    (1)   ------------------------------------------------------
Zeama_ARKL1    (1)   ------------------------------------------------------
Orysa_ARKL9    (1)   ------------------------------------------------------
Orysa_ARKL8  (145)   LLVGGHHFVNSFASSSSS--------------------------------A
Orysa_ARKL7  (148)   GSSSNTQFSRPMPPNPIPP-------------------------------
Orysa_ARKL6    (1)   ---------------------------------------------MARRDG
Orysa_ARKL5  (150)   GSSSSTQFSNYPQPAPFS--------------------------------
Orysa_ARKL4  (300)   RFLRNTRMRTSPNEYDQSSSNLLPEGSLRCSVYQPTQQQSLFIPVQPRAS
Orysa_ARKL3  (190)   LGQ-SGVCSSSCTNRPTIS-------------------------------RYAPAD
Orysa_ARKL1   (55)   -----HRAATAAKEASETP-------------------------------RRSQIF
  Consensus  (351)

401                                              450
Glyma_ARKL2    (1)   ------------------------------------------------------
Glyma_ARKL1  (349)   FSTGSMIRHSGVPPSSQVSQRLHFVDNSLNLRSAPPIDNVVP-QSQPLVI
Horvu_ARKL3   (80)   RK---KPPQG-------SSNPAEPCSETDNRTGETAAPGAGRDLLARLKD
Horvu_ARKL2  (313)   WPSSGSIRHPGS----YYHQAPAFQSAFDELEAAMPVVSGINLQYQHPGN
Horvu_ARKL1  (215)   AKPSYGLVSGEQRRVPRGLKNLGCTSVSDVLPSGCSSDSVYRMSFDAMRK
Zeama_ARKL2    (1)   ------------------------------------------------------
Zeama_ARKL1    (1)   ------------------------------------------------------
Orysa_ARKL9    (1)   ----------------------------MDAAKDTTAAAADQNPTPNP
Orysa_ARKL8  (164)   YVPP-----N--P----LHRSWNASFEANILPSTGVSNPPEYSSADSLNN
Orysa_ARKL7  (167)   PESCVRMPSHLGSNHWNDHRYVNHEGSQRNVRGRHDHSTIHLEQSPAAAC
Orysa_ARKL6    (7)   VGGDGGASAAEQQRRVALRVLLSRAEASS--PPPATVEEEAQRGRSGGGN
Orysa_ARKL5  (168)   ESLHRQMPPSVGPINWNDQSLVNQEGSQRNVRARHNFNNISLE-------
Orysa_ARKL4  (350)   SSSTSSLSRPYVPAVTQFSQNLHRAPSSGNFGSRIGIFPSSADTTNQLSS
Orysa_ARKL3  (214)   VKRPCNHASGVQQ---HGHNNLDCTSVPNFLPSGCSSGSVYSRRFDAMRK
Orysa_ARKL1   (75)   RKPSTRTPQGSTATDNISRNAASSYSENDNRPRE--TP--GRDLIARLKE
  Consensus  (401)                                                 L S 451                                              500
Glyma_ARKL2    (1)   -------------------------MTSASELFHTRRHRLGR
Glyma_ARKL1  (398)   HVPALPRNRQSFRWSGGSSSRNIHSSNSVICADRDQQDASSRRMSRNMLE
Horvu_ARKL3  (120)   RVNASRKRSLAREMSSSSSSGGFSASSSGGGATRSSAVSRPTRRAASRI
Horvu_ARKL2  (359)   VVPGIPQTAQRFAGRAAASSSRAGSLDNIILGREDVRNLVVP-------S
Horvu_ARKL1  (265)   RASDGDGSSRSRFISGPSSLGHSHTIYPSISG-PRIRTTEESVRQQK--L
Zeama_ARKL2    (1)   ------------------------------------------------------
Zeama_ARKL1    (1)   ------------------------------------------------------
Orysa_ARKL9   (21)   PTAAAPPDDSAAAAAAGRRPFTSLTQEEADLALARVLQEQERAYMMLSAH
Orysa_ARKL8  (203)   SNSMASHPELVHHGNYVFPAGHMSQYNAWIAQASRTGGVPQWEHGNAAAN
Orysa_ARKL7  (217)   PSSSINVPPYHPNANGPFGSAPVQRDRAPLSVHPRILPPGPDGSSIAFRE
Orysa_ARKL6   (55)   KGLASAALRGLGCTSTAALRAHAPASAVEVASS-SERWHGRRRRRKVQER
Orysa_ARKL5  (211)   PR------PVHSTSN-VSQSTSMKRNGPSFSTRMRTMPSG--ASGMHSGE
Orysa_ARKL4  (400)   QDPNRSSVRGNFPEPLLLGSSLFPSDSAELLSMPGGRSNQQNSSSTIRTA
Orysa_ARKL3  (261)   RTSDGGSFSRSRGLSGTASLDDSPPAYPAIAG-PRIRTTTTERASQQNAL
Orysa_ARKL1  (121)   RVNASRKRSLNRENSPSSPN--GLSATSS----SSSRTVSRPSHRAASRI
  Consensus  (451)                            S           I
```

FIGURE 16 (continued)

```
                              501                                              550
Glyma_ARKL2    (18)  NALDLGLDTELHAADSLRQLRLRHYYLRRHHPERASDRIDGRYRRSFVSE
Glyma_ARKL1   (448)  HPVFVPATDLRNLVQNPTVRASSSSSENLSIPGNVASSSRTGSNPATN-P
Horvu_ARKL3   (170)  RKADEGENAGGARRAPRRDTGGGVGAR--RNSDDPVMVGQRAAR------
Horvu_ARKL2   (402)  FPNAAPHSALNMRHLVPELSNWNPDIPGATIPGNVSSVSRANATSTISRP
Horvu_ARKL1   (312)  RSRSRNIQDSAVSVRTRRTSPRDTRFRMSEETEDSVLHLNESNAGNQQSV
Zeama_ARKL2     (1)  --------------------------------------------------
Zeama_ARKL1     (1)  --------------------------------------------------
Orysa_ARKL9    (71)  HGGDYAASDGGSYEFDEEGEGSDFEDEDGDGDGDGEALDEDEEVADADAD
Orysa_ARKL8   (253)  PPG---GFVHSGTIDMPNGGLQGYQAGPFANYYGPLPHFHQNPLNSMQHP
Orysa_ARKL7   (267)  RPYYPAPQSTNISAPVPTLPISCDSAPFAHGGYAPRSAHRNNLRTYPPPA
Orysa_ARKL6   (104)  RSARGGGGGGGGGVAPPGPAPAAAGDVWCTCAPGIPFAAEASSVDCVVVA
Orysa_ARKL5   (252)  MPYTMG--SSNSSVPVPTLQGSSSSAIFASGVFAPRHVHGDTVPSYIHLP
Orysa_ARKL4   (450)  VNIGAQQIAGLNASQPTSSSRGSVDIVRRSLQAASVPQSRGSSITSQQQR
Orysa_ARKL3   (310)  RSR-RNFQDSAVSVRTRRP-PWGARFRISEEREDGMISQRDSSIGNQQSD
Orysa_ARKL1   (165)  RKADEGANAGAVN--VRRDSSGDTRRNSDRDVDDFLLVEQAAR-------
  Consensus   (501)

551                                              600
Glyma_ARKL2    (68)  SVDSEENVRSSLRGSS----------------------------------
Glyma_ARKL1   (497)  SSATTFSRSNPPQ-HPRRLSEYVRRSLFSPSSDAIGSPSHNYSSLRSGLS
Horvu_ARKL3   (212)  --EQAPTEGFISG-------FLAR--------------------------
Horvu_ARKL2   (452)  AGSTSIAHQNLHRRHPRNLSEEIGRLSG----------------------
Horvu_ARKL1   (362)  GADFSVEEGSSERSIRPVSVELPHAIYS----------------------
Zeama_ARKL2     (1)  --------------------------------------------------
Zeama_ARKL1     (1)  --------------------------------------------------
Orysa_ARKL9   (121)  AAGDPAELDPARYEDDEAFARALQDAEE----------------------
Orysa_ARKL8   (300)  ALFNHIQMQVPHQHCLSNNLLHHP--------------------------
Orysa_ARKL7   (317)  FASSSNPGAVSHEPAIPSYPPAAPSYP-----------------------
Orysa_ARKL6   (154)  RHHHAHHTAAAMGSGRR--GEAERRHRE----------------------
Orysa_ARKL5   (300)  SVASSSSTAIPHEVIIPSYQPATS--------------------------
Orysa_ARKL4   (500)  GHSSTSHEIRSHQPGSS--SRANQQHYV----------------------
Orysa_ARKL3   (358)  QVHSSSEEASTESSSRPFSAELPHAIYS----------------------
Orysa_ARKL1   (206)  ----DSTEGFISG-------FLAR--------------------------
  Consensus   (551)

601                                              650
Glyma_ARKL2    (84)  -----SERLPVGVVLARARLLQRLRGEPLSTNRQYDRDSFGEDP------
Glyma_ARKL1   (546)  TSEPRALSSGSGANPRSASWLERQGDSEFGIPYSLRTLAVASEGGSSRLV
Horvu_ARKL3   (227)  ----YRGSLQGG-----------------SSLQDGTEDSSGYWRFDVEGS
Horvu_ARKL2   (480)  -----ALRSQQHPRLRSGFLLERQGDGVWGVPLPMRNSREG------RRL
Horvu_ARKL1   (390)  ----SSRQGSSTRTARR-TSTSRFEQSPPQTFRSLARERGGHRRINMEGI
Zeama_ARKL2     (1)  --------------------------------------------------
Zeama_ARKL1     (1)  --------------------------------------------------
Orysa_ARKL9   (149)  ------REVAGRLMALAGLSDWRVMDHDDDDVDDDDDEDDDDDDD-----
Orysa_ARKL8   (324)  -----S-GNGLPLDPRILAISSNSGHTFGPTAQPSLANQVNAGSSRIQPY
Orysa_ARKL7   (344)  ---PATSAASSSVQPFHAEAAAHLRHPRHVSVGGSGSARSRRMRDSYHGF
Orysa_ARKL6   (180)  ----RPAAPRARRVTMREHISSSLMDSPPFPDMPLLNADLLP-----PPP
Orysa_ARKL5   (324)  ---ATTSTPMRASQPLPVRAVASSRHARNVLIGHANSGRNRRARSSYYGI
Orysa_ARKL4   (526)  ----RAVPHSVDRQNSNYLDLQSFMQSIAASRDGIRTVSESA-----NQL
Orysa_ARKL3   (386)  ----SRGEGSNAFTARRRRSSSLYEERPPQTFHDLFRERNGRRHISIEGI
Orysa_ARKL1   (219)  ----YRSNHQGLL----------------SSLDDSIEDANGYWRFNMEGS
  Consensus   (601)                                   S
```

FIGURE 16 (continued)

```
                      651                                            700
Glyma_ARKL2  (123)  ------------------------------------E-------------
Glyma_ARKL1  (596)  SELRNVLGLMRRGGNVRFEGKTAYNIPPPYLRIAKSLWAMGAIMASKLVQ
Horvu_ARKL3  (256)  EE------------------------------------------------
Horvu_ARKL2  (519)  MEIRNALEMIQRGENVRFE-------------------------------
Horvu_ARKL1  (435)  AEVLLVLERIEQEAELTYEQLR----------------------------
Zeama_ARKL2    (1)  MEIRNALEMIHRGENVRLE-------------------------------
Zeama_ARKL1    (1)  --------------------------------------------------
Orysa_ARKL9  (188)  D-------------------------------------------------
Orysa_ARKL8  (368)  EN--------------------------------AP--------------
Orysa_ARKL7  (391)  HHLMIEDNNLGRSA------------------------------------
Orysa_ARKL6  (221)  SGRHRHGYRHPHVGAAEEEIM-----------------------------
Orysa_ARKL5  (371)  QPLMID--------------------------------------------
Orysa_ARKL4  (567)  VHLRNVVEQIRQGRGGRFEDP-----------------------------
Orysa_ARKL3  (432)  AEVLLALDRIEQEAELTYEQLM----------------------------
Orysa_ARKL1  (249)  EE------------------------------------------------
  Consensus  (651)      L 701                                            750
Glyma_ARKL2  (124)  ------------------------------SESSNEDPSGASLVTELTSQM
Glyma_ARKL1  (646)  SLYRSNSKNIITCPAPMQDVVILDHQSFLSGIADVRDRHRDMRLDVDNMS
Horvu_ARKL3  (258)  ---------------------------LENYFMLSDRHRAMRMDIDGMS
Horvu_ARKL2  (538)  ---------------------------SIFYGGVEIHDRHRDMRLDIDNMS
Horvu_ARKL1  (457)  ---------------------------VLETNLLLGAFTSHDHHSDMRMDIDNMS
Zeama_ARKL2   (20)  ---------------------------SIFYGGVDIHDRHRDMRLDIDNMS
Zeama_ARKL1    (1)  ---------------------------MFQTRVLLGGMNMYDRYQDWRLDVDNMT
Orysa_ARKL9  (189)  ---------------------------EDEDGDDPQDAWEDVDPDEYS
Orysa_ARKL8  (372)  ---------------------------FVDLSRLYEAGVIDEHRDMRLDVDSMT
Orysa_ARKL7  (405)  ---------------------------AERFMMLDQLVIHESREAFDPHWDMRLDIDDMS
Orysa_ARKL6  (242)  ---------------------------MLRTRLLWGRFGMHDQHQDWRLDVDNMT
Orysa_ARKL5  (377)  ---------------------------AQQLIMMQQFALRESREAQDPHRAMRLDIDNMS
Orysa_ARKL4  (588)  ---------------------------NFERALFARRASLIDRHRDMRLDVDNMS
Orysa_ARKL3  (454)  ---------------------------VLETNILLGAFTSHDQHSDMRMDIDNMS
Orysa_ARKL1  (251)  ---------------------------LENYFIFNDRYRGMRMDIDGMS
  Consensus  (701)                              IL    I D HRDMRLDIDNMS 751                                            800
Glyma_ARKL2  (145)  AR---SQFLQELSTKPPGLTQEALDCLHQEVFSSNASEIG--LDSRVLQD
Glyma_ARKL1  (696)  Y-EELLALEERIGNVSTGLSEETVLKHLQRKHSAE---K-GPQ-IDAEP
Horvu_ARKL3  (280)  Y-EELLALGDRIGTVNTGLSEDALYKCLKRSLYTPTAP---ETHLDCDRK
Horvu_ARKL2  (562)  Y-EELLALEERIGNVSTGLTENDVMKLLQRKFSSW---R-LSS-MEFEP
Horvu_ARKL1  (485)  Y-EELLALEERIGFVSTALSEEQFAKCIRRRLYRPVAAKG-NKTAIDDIK
Zeama_ARKL2   (44)  Y-EELLALEERIGNVGTGLSEEAVIRLLKQRKFSSW---T-LKASLDPEP
Zeama_ARKL1   (29)  Y-EELLELGDKIGYVNTGLRDDEITRNLRKVKHPSFSS-L-RFATEMERK
Orysa_ARKL9  (210)  Y-EELVALGEVVGTESRGLSADTLASLPSITYRAQDKQDG------NMEQ
Orysa_ARKL8  (399)  Y-EELVALEERIGNVNSGFTESYIEENLKSSSYVPDADCMPDQSSVEKDA
Orysa_ARKL7  (438)  Y-EELLALEERIGHVNTGLADEKISGCVMEVACCSSSH---LQDDQDNER
Orysa_ARKL6  (270)  Y-EELLDLEDRIGYVSTGLHDDEIARSLRMVKYSAFNP-K-HFATEVERN
Orysa_ARKL5  (410)  Y-EDLLALGESIGNVCTGLVDEKISGCVREVIYCSSDE---QQNDQDDGK
Orysa_ARKL4  (616)  Y-EELLALGERIGYVNTGLSEDKIRTGLKQWKYVSIPI-E-EPLTGVEP-
Orysa_ARKL3  (482)  Y-EELLALGDRIGSVSTALSEEQFVKCLRRSIYIPVATKA-NAQVVDDIK
Orysa_ARKL1  (273)  Y-EELLALGDRIGTVSTGLSEDALSKCLDRSMYMATTS---GTHEDCERK
  Consensus  (751)  Y EELLAL ERIG V TGLSEE  I K LK    Y S         DD
```

FIGURE 16 (continued)

```
                   801                                              850
Glyma_ARKL2  (190) CSICLESFTDGDELIRLPCGHKFHSVCLDPWIRCCGDCPYCRRCIVVNTH
Glyma_ARKL1  (740) CCVCQEDYGDEDDIGTLDCGHDFHSSCIKQWLMHKNLCPICKTTGLAT--
Horvu_ARKL3  (326) CSICQEEYSGGEEVGNMACKHYYHITCIQHWLRQKNWCPICKSVAAKTV-
Horvu_ARKL2  (606) CCICQEDYVEGDDLGTLHCGHDFHASCISQWLVVKNLCPICKSTALKT--
Horvu_ARKL1  (533) CSICQEEFVKGEEVGRLRCEHQYHVCCIRQWLLQKNWCPVCKAPALPSMN
Zeama_ARKL2   (89) CCICQEEYADGDDLGRLDCGHDFHAGCIKQWLVVKNVCPICKSTALKKT-
Zeama_ARKL1   (76) CSICQEEFETNEEMGRLDCGHSYHVYCIKQWLSQKNICPVCKTAVSKN--
Orysa_ARKL9  (253) CVICRVEFEEGESLVALPCKHSYHSECINQWLQLNKVCPMCSAEVPTSQD
Orysa_ARKL8  (448) CIICQEEYEAKELVGTLGCGHKYHAMCIKGWLMVKNLCPICKTTALPADR
Orysa_ARKL7  (484) CVICLEEYKHEDTLGRLKCGHGFHCNCIKKWLQVKNTCPVCKAAAADEGS
Orysa_ARKL6  (317) CSICQEEFEANEETGRLICGHSYHVQCIKQWLSRKNTCPVCKTVVSKT--
Orysa_ARKL5  (456) CAICLEEYKDNSLLGILKCNHDFHTDCVKKWLKEKNSCPICKSAAA----
Orysa_ARKL4  (662) CCICQEEYAEGEDMGRLDCGHDFHTACIKQWLVIKNLCPICKKTGLGT--
Orysa_ARKL3  (530) CSICQEEYIEGEEVGRLGCEHQYHVCCIHQWLRQKNWCPICKASAEPSTV
Orysa_ARKL1  (319) CSICQEEYSDGEEVGKMVCKHYYHFSCIKNWLRQKNWCPICKSVALNTN-
  Consensus  (801) CSICQEEY DGEELGRL CGH YH  CIKQWL  KN CPICKS AL T 851
Glyma_ARKL2  (240) SSLNEDE
Glyma_ARKL1  (788) -------
Horvu_ARKL3  (375) -------
Horvu_ARKL2  (654) -------
Horvu_ARKL1  (583) -------
Zeama_ARKL2  (138) -------
Zeama_ARKL1  (124) -------
Orysa_ARKL9  (303) TRA----
Orysa_ARKL8  (498) RNG----
Orysa_ARKL7  (534) -------
Orysa_ARKL6  (365) -------
Orysa_ARKL5  (502) -------
Orysa_ARKL4  (710) -------
Orysa_ARKL3  (580) S------
Orysa_ARKL1  (368) -------
  Consensus  (851)
```

FIGURE 16 (continued)

SEQ ID NO: 212 - DNA - Oryza sativa
ATGGATGATCACATGGGAAGACGGACAGTTGGTGGCCTTCTCTTCACCAAGGGGGGCTCAATTCTTCT
CTTCAGAGAAGACAGTGCGCGTCACAAGGCCACCAATTGCTGCACGCGACACGGTTGCAGCAGCAAGC
ATTTGGCCGGCAAAGACAAGCAAACACACAGGGCAGCAACAGCAGCCAAGGAAGCATCAGAAACCCCT
CGGAGATCACAGATTTTCAGGAAACCCAGCACGAGGACTCCTCAGGGAAGTACTGCTACTGATAACAT
CAGCAGGAATGCAGCAAGCTCCTATAGCGAAAACGACAATAGGCCAAGAGAAACTCCAGGGCGTGATT
TAATCGCTCGTCTCAAAGAGAGGGTCAATGCATCAAGAAAACGATCATTGAACAGAGAAAACAGTCCA
TCATCACCAAATGGATTAAGTGCTACTTCCTCAAGTAGTAGCCGCACAGTCTCAAGACCGTCGCATCG
GGCAGCTTCCCGAATAAGGAAGGCAGATGAAGGTGCAAATGCAGGAGCTGTAAATGTACGCAGAGACA
GCAGTGGAGATACCAGGAGGAATTCAGATAGGGATGTCGATGATTTCTTGCTAGTTGAGCAGGCAGCA
AGAGATAGCACTGAAGGATTCATATCTGGATTCTTGGCAAGATACAGAAGTAATCATCAGGGACTACT
TTCATCTTTGGACGACAGCATAGAGGATGCAAATGGGTACTGGCGCTTCAATATGGAAGGAAGTGAAG
AGCTTGAGAACTACTTCATATTCAATGATCGGTACAGAGGGATGAGAATGGACATTGACGGCATGTCT
TATGAGGAATTGCTAGCATTGGGAGATAGAATTGGCACCGTAAGCACTGGCCTTTCAGAAGACGCGCT
GTCCAAGTGTCTAGACAGAAGCATGTACATGGCCACTACTTCAGGAACTCATGAAGATTGTGAGAGAA
AATGCAGCATATGCCAGGAGGAATATTCAGATGGTGAGGAGGTGGGCAAGATGGTCTGCAAACATTAC
TACCACTTCTCCTGCATAAAGAACTGGCTCCGGCAGAAGAACTGGTGTCCCATTTGTAAATCCGTCGC
TCTGAATACCAACTAG

SEQ ID NO: 213 - protein - Oryza sativa
MDDHMGRRTVGGLLFTKGGSILLFREDSARHKATNCCTRHGCSSKHLAGKDKQTHRAATAAKEASETP
RRSQIFRKPSTRTPQGSTATDNISRNAASSYSENDNRPRETPGRDLIARLKERVNASRKRSLNRENSP
SSPNGLSATSSSSSRTVSRPSHRAASRIRKADEGANAGAVNVRRDSSGDTRRNSDRDVDDFLLVEQAA
RDSTEGFISGFLARYRSNHQGLLSSLDDSIEDANGYWRFNMEGSEELENYFIFNDRYRGMRMDIDGMS
YEELLALGDRIGTVSTGLSEDALSKCLDRSMYMATTSGTHEDCERKCSICQEEYSDGEEVGKMVCKHY
YHFSCIKNWLRQKNWCPICKSVALNTN

SEQ ID NO: 214 - DNA - Oryza sativa
ATGGATGATCACATGGGAAGACGGACAGTTGGTGGCCTTCTCTTCACCAAGGGGGGCTCAATTCTTCT
CTTCAGAGAAGACAGTGCGCGTCACAAGGCCACCAATTGCTGCACGCGACACGGTTGCAGCAGCAAGC
ATTTGGCCGGCAAAGACAAGCAAACACACAGGGCAGCAACAGCAGCCAAGGAAGCATCAGAAACCCCT
CGGAGATCACAGATTTTCAGGAAACCCAGCACGAGGACTCCTCAGGGAAGTACTGCTACTGATAACAT
CAGCAGGAATGCAGCAAGCTCCTATAGCGAAAACGACAATAGGCCAAGAGAAACTCCAGGGCGTGATT
TAATCGCTCGTCTCAAAGAGAGGGTCAATGCATCAAGAAAACGATCATTGAACAGAGAAAACAGTCCA
TCATCACCAAATGGATTAAGTGCTACTTCCTCAAGTAGTAGCCGCACAGTCTCAAGACCGTCGCATCG
GGCAGCTTCCCGAATAAGGAAGGCAGATGAAGGTGCAAATGCAGGAGCTGTAAATGTACGCAGAGACA
GCAGTGGAGATACCAGGAGGAATTCAGATAGGGATGTCGATGATTTCTTGCTAGTTGAGCAGGCAGCA
AGAGATAGCACTGAAGGATTCATATCTGGATTCTTGGCAAGATACAGAAGTAATCATCAGGGACTACT
TTCATCTTTGGACGACAGCATAGAGGATGCAAATGGGTACTGGCGCTTCAATATGGAAGGAAGTGAAG
AGCTTGAGAACTACTTCATATTCAATGATCGGTACAGAGGGATGAGAATGGACATTGACGGCATGTCT
TATGAGGAATTGCTAGCATTGGGAGATAGAATTGGCACCGTAAGCACTGGCCTTTCAGAAGACGCGCT
GTCCAAGTGTCTAGACAGAAGCATGTACATGGCCACTACTTCAGGAACTCATGAAGATTGTGAGAGAA
AATGCAGCATATGCCAGGCAAGAATATTCAGATGGTGA

FIGURE 19

SEQ ID NO: 215 - protein - Oryza sativa
MDDHMGRRTVGGLLFTKGGSILLFREDSARHKATNCCTRHGCSSKHLAGKDKQTHRAATAAKEASETP
RRSQIFRKPSTRTPQGSTATDNISRNAASSYSENDNRPRETPGRDLIARLKERVNASRKRSLNRENSP
SSPNGLSATSSSSSRTVSRPSHRAASRIRKADEGANAGAVNVRRDSSGDTRRNSDRDVDDFLLVEQAA
RDSTEGFISGFLARYRSNHQGLLSSLDDSIEDANGYWRFNMEGSEELENYFIFNDRYRGMRMDIDGMS
YEELLALGDRIGTVSTGLSEDALSKCLDRSMYMATTSGTHEDCERKCSICQARIFRW SEQ ID NO: 216 - DNA - Oryza sativa
ATGGAGGATTATCCAAGTGGGAGATCAAAAGCAGCTATTGGATTTCTCAGAAGAGGTGGTGGTTTCTC
TTCGAGAAATCAAAGCACTGAAGAGAGGACCATTCAGAACTATGATGGACCAGGAATCACCACAAGAC
TCAATCCGATGAAAACCAGGCTGTCTGATAATCAGGAGAGACCAAGATACCTACGTGACTCATTCAGA
TCTTCAACCTCAATGGCCATTCATGGAAGCTCTTCCAAAGTTCCGCTTAGGAAATTCGGTGACGAAAA
ACGAAGGCAAACGTTGTTGGCAGGGGTAGACATTGCTGAAAGTAGCAGCAGAAATGCTGGGGGCAAAC
ATCTGGAGGGTAGTAATAAGAGAATCGTTGTCGATGATAGGAGTTCAGATGTTCTGCATACTGAAACA
GAAGGCTTGGCTACTGAACAAGACCAATTGATAGCACCCAATGCTGGAGTTTCTGATTCTGCTAGTTC
GTCAGATATTTCTGAACATGCAGTTGAATCCTTGGTAAGGAGTGCTGCTCCAAGTTCTAGAACCCGTA
GACAGAAGGACAAAGAATTGAATTTGGGTCAATCAGGAGTTTGCTCTTCGTCATGTACTAACAGGCCT
ACTATATCAAGATATGCTCCTGCCGATGTGAAGCGACCGTGTAATCATGCTAGCGGAGTACAACAGCA
TGGTCATAACAATCTGGACTGTACTTCAGTACCTAATTTTCTGCCATCAGGTTGCTCATCTGGTTCTG
TTTATAGCAGGAGGTTTGATGCAATGAGAAAAAGGACTTCTGATGGGGGAAGTTTTTCTAGATCAAGG
GGCTTAAGTGGAACGGCTAGCTTAGACGATTCACCTCCTGCATACCCTGCCATTGCTGGTCCTAGAAT
CAGAACAACTACAACTGAACGGGCTTCACAACAAAATGCACTAAGAAGCAGAAGGAATTTTCAGGATT
CAGCAGTGTCAGTAAGGACAAGAAGACCTCCTTGGGGTGCTAGGTTCAGGATCTCTGAGGAAAGAGAG
GATGGCATGATTTCTCAGCGTGATTCTTCCATAGGGAATCAACAGTCAGATCAGGTGCATTCATCTTC
GGAAGAGGCCTCTACAGAGAGCTCCTCAAGACCATTCTCTGCAGAATTACCTCATGCAATTTACTCAT
CTAGAGGAGAGGGATCAAATGCTTTCACTGCAAGGAGAAGAAGATCAAGCTCCCTTTATGAGGAAAGA
CCTCCACAGACATTCCATGATCTTTTCAGAGAAAGAAATGGCCGAAGACACATATCCATAGAAGGAAT
TGCAGAGGTATTACTAGCTCTGGACAGGATTGAACAAGAAGCAGAACTGACTTATGAGCAATTGATGG
TGTTGGAGACAAATATATTGCTTGGTGCTTTCACCTCCCATGATCAGCATAGTGACATGCGCATGGAT
ATCGACAACATGTCCTATGAGGAATTATTAGCATTAGGAGACAGAATAGGCTCTGTTAGCACCGCTCT
TTCTGAGGAGCAATTTGTGAAATGCCTCAGAAGAAGTATATATATACCAGTGGCTACAAAAGCAAACG
CGCAAGTTGTAGACGACATCAAATGCAGCATATGCCAGGAGGAGTACATAGAGGGTGAAGAAGTTGGA
CGGCTGGGATGTGAGCATCAGTACCATGTGTGCTGCATTCACCAGTGGCTCAGGCAGAAGAACTGGTG
TCCAATATGCAAAGCTTCAGCTGAACCTTCTACTGTGAGCTAA SEQ ID NO: 217 - protein - Oryza sativa
MEDYPSGRSKAAIGFLRRGGGFSSRNQSTEERTIQNYDGPGITTRLNPMKTRLSDNQERPRYLRDSFR
SSTSMAIHGSSSKVPLRKFGDEKRRQTLLAGVDIAESSSRNAGGKHLEGSNKRIVVDDRSSDVLHTET
EGLATEQDQLIAPNAGVSDSASSSDISEHAVESLVRSAAPSSRTRRQKDKELNLGQSGVCSSSCTNRP
TISRYAPADVKRPCNHASGVQQHGHNNLDCTSVPNFLPSGCSSGSVYSRRFDAMRKRTSDGGSFSRSR
GLSGTASLDDSPPAYPAIAGPRIRTTTTERASQQNALRSRRNFQDSAVSVRTRRPPWGARFRISEERE
DGMISQRDSSIGNQQSDQVHSSSEEASTESSSRPFSAELPHAIYSSRGEGSNAFTARRRRSSSLYEER
PPQTFHDLFRERNGRRHISIEGIAEVLLALDRIEQEAELTYEQLMVLETNILLGAFTSHDQHSDMRMD
IDNMSYEELLALGDRIGSVSTALSEEQFVKCLRRSIYIPVATKANAQVVDDIKCSICQEEYIEGEEVG
RLGCEHQYHVCCIHQWLRQKNWCPICKASAEPSTVS FIGURE 19 (continued)

SEQ ID NO: 218 - DNA - Oryza sativa
ATGCATCAACATAGGATCACTATGCTATCTTCCTCAGAAACATGTCACCTTGGTTCTAGTTCGAACAA
CCAAGCCATGGATCAGCAGAATTTACTGCCCAGCAACCCCACCGCAGATGAACAGAATTTACTTCCAA
ATACTCTAGAGGATGATGATTACCCACATTATTTACTTGGTAGTCATGAGGTGGAAATGCCAAATGGA
AGCGTGATTGGTCAGCAAAATACAAGCTTGAACTTATGGGATTCAGCTGGATCTAGCTCGATGGGCTG
TGTAGCTGATCATGATAGTCTTTTTGAGGCCAAAAGGGAACATTTTGCTCCTGCTTTGTCTATCCGAG
CTCCCTTAATTATTGGAGGGAGAAGACATGAAGGCAGTAGTTCATTGCCTTCACAGAGCTTAAACTTA
GACCTTAATCTTAATCAGGCTGATCAGTTTGATTCTGAGGATGTTGATATGATTCAGAGTAATGGACA
ACCAGGGATAAACGCTTTTCCTCTCAACAGGGGCCTTTCCATTCCTGAGCATGTTCTGCGCCATACAA
ATTCTTCCAGTGCTACAGGAAATCCTTCACAGGTTGCAAGCTTTTCTGATGGAATGACAGGCCAAGAA
GTTAACCTGTTTGGTGGGCATCGTTCATCTTGCAAGAGAAAGAATATTGATGGGAGTCTTGCAGAGTC
TTCTGCCAATGGTAGTTCACGTAATAATCAGCGAAATAATATTATACTGGAACCTTCTCCATCCAGTC
ATGAAAGCACTTCTGGTTTAACTGCACCTGCCCCTACAAACCATGTTTTTTCATACTCTCCTGTGGAA
CAGCTAAACCAGAATACCAATATGTCTGCAAATGCTATGTTGTCTGATCATTATTCACTATATGGTGA
TCATGAGCGTGAGAGATTTCTGAGGAATACCCGGATGAGAACAAGCCCTAATGAGTATGATCAATCAT
CGTCCAATCTCTTGCCTGAAGGAAGTCTCAGGTGTTCTGTTTATCAGCCTACTCAGCAACAGTCTTTG
TTTATTCCAGTACAACCTAGAGCATCGAGCTCTTCAACAAGTTCTCTTAGTCGGCCTTATGTGCCTGC
TGTCACTCAATTCTCACAAAATTTGCACCGTGCTCCATCAAGTGGCAATTTTGGTTCGAGAATAGGGA
TTTTTCCTAGTTCTGCTGATACAACAAACCAGTTATCTTCACAAGATCCCAACAGGAGCTCGGTGAGA
GGCAATTTTCCTGAGCCCCTTCTGTTAGGTTCTTCTCTGTTTCCTTCTGACTCGGCAGAATTGCTATC
TATGCCGGGAGGCAGAAGCAACCAACAAAATTCCAGCTCCACAATTCGAACTGCTGTAAATATAGGAG
CTCAACAGATTGCTGGGTTAAATGCATCCCAGCCTACTTCAAGCTCAAGGGGTTCGGTTGATATTGTT
AGGAGATCCTTGCAGGCTGCTAGCGTTCCTCAGTCCAGAGGTTCAAGCATTACATCACAGCAGCAACG
TGGGCATTCATCCACATCACATGAGATTCGAAGCCATCAACCTGGATCCAGCTCTCGTGCCAATCAGC
AGCATTATGTCAGGGCTGTTCCTCACTCTGTAGATAGGCAAAACTCGAATTACTTGGACCTGCAGTCT
TTTATGCAAAGCATTGCTGCTTCAAGAGACGGAATTAGGACAGTCTCAGAGTCTGCCAATCAACTTGT
GCATCTTCGCAATGTTGTTGAACAAATTCGTCAGGGAAGAGGTGGAAGGTTTGAGGATCCTAATTTTG
AACGTGCACTTTTTGCAAGGCGTGCCAGTTTAATTGACAGACATCGTGACATGCGGCTTGATGTGGAT
AATATGTCATATGAGGAATTGTTGGCACTTGGTGAACGCATTGGGTATGTAAACACTGGACTTAGTGA
GGATAAAATTAGGACTGGTTTGAAGCAATGGAAATATGTGAGCATACCGATTGAAGAACCTCTAACTG
GTGTTGAACCATGCTGTATTTGCCAGGAAGAATATGCCGAAGGTGAGGACATGGGCAGACTAGACTGT
GGGCATGACTTCCACACCGCATGCATCAAACAATGGCTGGTTATAAAAAATCTGTGCCCTATCTGTAA
AAAGACAGGACTGGGCACTTAA

SEQ ID NO: 219 - protein - Oryza sativa
MHQHRITMLSSSETCHLGSSSNNQAMDQQNLLPSNPTADEQNLLPNTLEDDDYPHYLLGSHEVEMPNG
SVIGQQNTSLNLWDSAGSSSMGCVADHDSLFEAKREHFAPALSIRAPLIIGGRRHEGSSSLPSQSLNL
DLNLNQADQFDSEDVDMIQSNGQPGINAFPLNRGLSIPEHVLRHTNSSSATGNPSQVASFSDGMTGQE
VNLFGGHRSSCKRKNIDGSLAESSANGSSRNNQRNNIILEPSPSSHESTSGLTAPAPTNHVFSYSPVE
QLNQNTNMSANAMLSDHYSLYGDHERERFLRNTRMRTSPNEYDQSSSNLLPEGSLRCSVYQPTQQQSL
FIPVQPRASSSSTSSLSRPYVPAVTQFSQNLHRAPSSGNFGSRIGIFPSSADTTNQLSSQDPNRSSVR
GNFPEPLLLGSSLFPSDSAELLSMPGGRSNQQNSSSTIRTAVNIGAQQIAGLNASQPTSSSRGSVDIV
RRSLQAASVPQSRGSSITSQQQRGHSSTSHEIRSHQPGSSSRANQQHYVRAVPHSVDRQNSNYLDLQS
FMQSIAASRDGIRTVSESANQLVHLRNVVEQIRQGRGGRFEDPNFERALFARRASLIDRHRDMRLDVD
NMSYEELLALGERIGYVNTGLSEDKIRTGLKQWKYVSIPIEEPLTGVEPCCICQEEYAEGEDMGRLDC
GHDFHTACIKQWLVIKNLCPICKKTGLGT

FIGURE 19 (continued)

SEQ ID NO: 220 - DNA - Oryza sativa
ATGGCTAGACACCATGGAAACCATTCCCTACTGCCAGAGATGGTTCAACCCAATAATGAGCAACTCAA
CCAACCTCTGCCTTTAGGTCAGAAGTTATTTGTGCATGCTGGAAATGATGCAGCCCTTAAAATTGGCC
CTTCATACCATGGAATGTGGCAATTAGATCGAATGATCTTCCATCTTCAAGTCGAGTGGCACAATAT
TCAGGTCATAGAGTTAAAAACACAGGAACCTTACATAACTCCTATGTTCACTATCCTGCTGGAAGCTC
TGGTGGCCATGTATCCTACAATCCTCAAACTGAACCTGTTATAACTTATCCACATAGATCTGAGGGAG
AATTTGCTCGAGGGAGTTCCCAAATCGACAACAGAACTGCTGCAGTGAAACGAAAAAATCCTGTCATT
TATCCAGAGTATAGCATCAATGGTGATGGTTATTGTGCCGGTAGCTCATCAAGTACCCAGTTCTCTAA
TTATCCACAGCCAGCTCCATTTTCTGAGTCCTTGCATCGTCAAATGCCTCCAAGTGTTGGCCCAATTA
ATTGGAATGACCAGAGCTTGGTAAATCAAGAAGGAAGTCAGAGAAATGTGAGGGCACGTCATAATTTT
AATAATATTTCATTGGAACCTAGACCAGTCCATTCTACTTCGAATGTTTCCCAAAGTACATCAATGAA
AAGGAATGGACCATCCTTTTCTACGCGAATGAGAACTATGCCTTCAGGTGCCTCTGGAATGCACTCTG
GAGAAATGCCTTACACTATGGGAAGCAGCAACTCATCTGTTCCTGTCCCAACTTTACAAGGCTCTTCA
AGCAGTGCAATATTTGCCAGTGGTGTCTTTGCACCTAGGCATGTTCATGGTGACACTGTTCCTAGCTA
CATTCATCTGCCTTCTGTAGCATCCTCTAGCTCTACAGCGATTCCCCATGAGGTGATCATTCCGAGCT
ACCAACCTGCTACCTCTGCAACTACCTCAACACCCATGAGGGCCAGTCAGCCATTACCTGTCAGAGCT
GTTGCATCTTCTAGACATGCAAGGAATGTACTCATAGGGCATGCTAACAGCGGAAGGAACAGAAGGGC
GAGAAGCTCATACTATGGTATTCAGCCTTTGATGATTGATGCACAGCAATTGATAATGATGCAACAAT
TTGCTCTCCGCGAATCAAGAGAAGCACAAGACCCCCACAGGGCCATGAGACTGGACATTGACAATATG
AGTTATGAGGACCTGCTGGCTTTGGGAGAATCTATTGGTAATGTCTGCACAGGCTTGGTGGACGAGAA
AATCTCAGGTTGTGTGAGAGAAGTGATCTATTGCAGTTCTGATGAACAGCAAAATGATCAAGATGATG
GGAAATGTGCAATTTGTCTGGAGGAATACAAAGACAACAGTTTGCTGGGAATACTGAAATGCAATCAC
GACTTCCACACCGACTGCGTCAAGAAGTGGTTGAAGGAGAAGAACTCATGCCCAATTTGCAAGTCGGC
TGCTGCATAG

SEQ ID NO: 221 - protein - Oryza sativa
MARHHGNHSLLPEMVQPNNEQLNQPLPLGQKLFVHAGNDAALKIGPSYHGNVAIRSNDLPSSSRVAQY
SGHRVKNTGTLHNSYVHYPAGSSGGHVSYNPQTEPVITYPHRSEGEFARGSSQIDNRTAAVKRKNPVI
YPEYSINGDGYCAGSSSSTQFSNYPQPAPFSESLHRQMPPSVGPINWNDQSLVNQEGSQRNVRARHNF
NNISLEPRPVHSTSNVSQSTSMKRNGPSFSTRMRTMPSGASGMHSGEMPYTMGSSNSSVPVPTLQGSS
SSAIFASGVFAPRHVHGDTVPSYIHLPSVASSSSTAIPHEVIIPSYQPATSATTSTPMRASQPLPVRA
VASSRHARNVLIGHANSGRNRRARSSYYGIQPLMIDAQQLIMMQQFALRESREAQDPHRAMRLDIDNM
SYEDLLALGESIGNVCTGLVDEKISGCVREVIYCSSDEQQNDQDDGKCAICLEEYKDNSLLGILKCNH
DFHTDCVKKWLKEKNSCPICKSAAA

SEQ ID NO: 222 - DNA - Oryza sativa
ATGGCTCGCCGCGACGGCGTCGGCGGCGACGGCGGCGCGTCGGCGGCGGAGCAGCAGCGGAGAGTAGC
GCTGCGTGTGCTGCTGTCCCGTGCGGAGGCTTCCTCGCCGCCGCCGGCGACGGTGGAGGAGGAGGCGC
AGCGGGGGAGGAGCGGTGGTGGTAACAAGGGGCTCGCGTCGGCGGCGCTGCGCGGGCTCGGGTGCACG
TCGACGGCGGCGCTGCGTGCCCACGCGCCGGCTTCGGCGGTGGAGGTGGCGAGTAGCTCGGAGCGGTG
GCACGGGAGGCGGCGGCGGAGGAAGGTGCAGGAGAGGCGGAGCGCGAGGGGCGGCGGCGGAGGAGGAG
GAGGAGGCGTGGCGCCGCCCGGCCCCGCGCCGGCGGCGGCCGGGGACGTGTGGTGCACGTGCGCTCCC
GGGATACCGTTCGCCGCCGAGGCGTCGTCGGTGGACTGCGTCGTGGTGGCGCGCCACCACCACGCCCA
CCACACGGCGGCGGCGATGGGCTCCGGCCGCCGCGGGAGGCGGAGCGGCGCCACAGAGAGAGGCCGG FIGURE 19 (continued)

```
CCGCTCCTCGAGCTCGAAGGGTGACCATGCGTGAGCACATATCCTCGTCGCTCATGGACTCGCCGCCG
TTCCCCGACATGCCGCTCCTCAACGCCGACCTGCTACCACCACCACCCTCCGGCCGCCACCGCCATGG
ATACCGCCACCCCCACGTCGGCGCCGCCGAGGAAGAGATCATGATGTTAAGAACACGGCTATTATGGG
GAAGATTCGGTATGCATGATCAGCACCAGGATTGGCGACTCGACGTTGACAACATGACATATGAGGAG
CTGCTGGATCTTGAAGACAGAATTGGGTATGTAAGCACAGGGTTGCATGACGATGAAATCGCTCGCAG
CCTTAGGATGGTCAAGTATTCAGCATTCAACCCCAAGCATTTTGCAACAGAAGTAGAAAGGAATTGCA
GTATTTGTCAGGAAGAATTTGAAGCAAATGAGGAAACAGGGAGGCTGATCTGTGGCCACAGCTATCAT
GTGCAATGCATAAAGCAGTGGCTTTCTAGGAAGAACACCTGCCCTGTCTGCAAAACTGTTGTATCGAA
GACATGA
```

SEQ ID NO: 223 - protein - Oryza sativa
```
MARRDGVGGDGGASAAEQQRRVALRVLLSRAEASSPPPATVEEEAQRGRSGGGNKGLASAALRGLGCT
STAALRAHAPASAVEVASSSERWHGRRRRRKVQERRSARGGGGGGGGGVAPPGPAPAAAGDVWCTCAP
GIPFAAEASSVDCVVVARHHHAHHTAAAMGSGRRGEAERRHRERPAAPRARRVTMREHISSSLMDSPP
FPDMPLLNADLLPPPPSGRHRHGYRHPHVGAAEEEIMMLRTRLLWGRFGMHDQHQDWRLDVDNMTYEE
LLDLEDRIGYVSTGLHDDEIARSLRMVKYSAFNPKHFATEVERNCSICQEEFEANEETGRLICGHSYH
VQCIKQWLSRKNTCPVCKTVVSKT
```

SEQ ID NO: 224 - DNA - Oryza sativa
```
ATGGCTGGACATCAGTATAATAATTCCCAGATGTCCCGGATGGATCATATGGACAGGCTAAACAATGA
ACCTCCACCTTTTGGCCAAAAGTTATTTATGCATCCTAGGAGTGATCCAGCTAACGGAGCTGGATCGT
CTGGCTATGTGGGTAACACAATGAGATCGAATGATCTTCGTCTTCAAGTTATGCTGGCCAAGCTTAT
GGTCAGCAGAATAGAGCCCCCATCCATGCTTCATATTCTGGTCATGCACCTGCTGGAAGCTCTAGTGG
TAGCTATGCACCATACAATACTCAACATATGCCTGCTTCAAGCTATCCACACGGATCCGAGGATAATT
TCATTCCAAGTTCCCATGTGGATGGCAGAAGGGTTGCATTGAAGAGAAGAAATCCCATCATTCATCCT
ACAGATGGATTCGGTGTTGGAAATTATTATGCTGGCAGTTCTTCCAATACTCAGTTCTCTCGGCCCAT
GCCTCCAAATCCTATTCCACCTCCTGAATCCTGTGTTCGAATGCCCTCACACTTGGGTTCGAACCACT
GGAATGATCACCGCTATGTTAATCATGAAGGATCTCAGAGGAATGTGAGGGGAAGACATGATCATAGT
ACTATCCATTTGGAACAAAGTCCAGCTGCAGCTTGCCCGTCAAGCAGCATCAATGTGCCACCATACCA
TCCAAATGCAAATGGTCCTTTTGGAAGTGCACCAGTACAACGTGACAGAGCTCCTTTATCTGTGCATC
CAAGAATTCTTCCTCCAGGGCCTGATGGTAGTAGCATAGCATTCAGAGAGAGGCCATACTATCCTGCT
CCACAGAGCACCAACATAAGTGCACCTGTGCCAACGCTTCCTATTTCTTGTGACAGTGCACCATTTGC
TCATGGTGGGTACGCCCCTAGATCAGCTCATCGTAACAACTTACGCACTTATCCTCCTCCAGCTTTTG
CATCTTCTTCCAACCCTGGAGCAGTCTCCCATGAGCCAGCTATTCCTAGCTATCCACCTGCTGCCCCT
AGCTATCCACCTGCAACCTCTGCAGCATCATCAAGTGTCCAGCCATTTCATGCTGAAGCTGCTGCACA
TTTGAGGCATCCAAGGCATGTATCTGTAGGGGCAGTGGTAGTGCAAGGAGTAGAAGGATGAGGGATT
CCTATCATGGTTTTCATCATTTGATGATTGAAGACAATAACTTGGGAAGATCAGCAGCTGAGCGGTTT
ATGATGCTGGATCAGTTAGTTATCCATGAATCAAGAGAAGCATTCGATCCTCACTGGGACATGAGACT
GGACATTGATGACATGAGCTATGAGGAGCTGCTGGCTTTGGAAGAACGCATAGGCCATGTGAACACTG
GCCTCGCTGATGAGAAATTTCTGGCTGTGTGATGGAGGTAGCCTGCTGCAGCAGTAGTCATTTGCAG
GATGATCAGGACAATGAAAGATGTGTAATCTGCCTGGAGGAATACAAGCATGAGGACACACTTGGGAG
GCTGAAATGCGGCCACGGGTTTCACTGCAATTGCATCAAGAAGTGGCTGCAGGTGAAGAACACCTGCC
CAGTTTGCAAAGCTGCTGCCGCAGATGAAGGCAGCTGA
```

SEQ ID NO: 225 - protein - Oryza sativa
MAGHQYNNSQMSRMDHMDRLNNEPPPFGQKLFMHPRSDPANGAGSSGYVGNTMRSNDLPSSSYAGQAY
GQQNRAPIHASYSGHAPAGSSSGSYAPYNTQHMPASSYPHGSEDNFIPSSHVDGRRVALKRRNPIIHP
TDGFGVGNYYAGSSSNTQFSRPMPPNPIPPPESCVRMPSHLGSNHWNDHRYVNHEGSQRNVRGRHDHS
TIHLEQSPAAACPSSSINVPPYHPNANGPFGSAPVQRDRAPLSVHPRILPPGPDGSSIAFRERPYYPA
PQSTNISAPVPTLPISCDSAPFAHGGYAPRSAHRNNLRTYPPPAFASSSNPGAVSHEPAIPSYPPAAP
SYPPATSAASSSVQPFHAEAAAHLRHPRHVSVGGSGSARSRRMRDSYHGFHHLMIEDNNLGRSAAERF
MMLDQLVIHESREAFDPHWDMRLDIDDMSYEELLALEERIGHVNTGLADEKISGCVMEVACCSSSHLQ
DDQDNERCVICLEEYKHEDTLGRLKCGHGFHCNCIKKWLQVKNTCPVCKAAAADEGS

SEQ ID NO: 226 - DNA - Oryza sativa
ATGTTACAAAGAAATATGGTGTGGACACATCAAGTTGCCAGTCCTGAAAACCAAGTTCAACCTGAAAG
TTTCTATCATGGAGGTGCTGGGAGCAACTTATCTAACCTGAGTGTGCAAGTTGCTGTTGGAGTTCCAG
GAAATACTGATTTCCGGAGTCACTATGAGAGCATTAATCTTCAGCACCAGCATGTTCAGAATCCATAC
CCACATGTGGGTGTTGCTTCAAGTTCTGTGTTCCCATCTACTATGTACAACCCCTGCATATCAACAAC
AGCAGTGGACAGATATGTTCCTCCTATTCAAAGTTTTGGATTGGGCAATCCACTACTACTGCCTTTAT
ATCATCAACTTGCTCAAGGATCCATGGATGAGAACGGCAGCAGTGGCAATTTTTGTGACAGCGTCAGG
GAATTTATCAAGAGGAAAAATGCATTACTTGTGGGTGGCCATCATTTTGTTAATAGTTTTGCAAGCTC
AAGCTCATCTGCTTATGTGCCTCCAAATCCTTTACATAGGTCATGGAACGCTTCATTTGAAGCAAATA
TCCTACCCAGCACTGGAGTTTCCAATCCACCAGAGTACTCTTCTGCAGATTCACTGAACAATTCCAAT
TCGATGGCTTCACATCCAGAATTGGTGCATCATGGCAATTATGTATTTCCAGCTGGTCACATGAGCCA
ATACAATGCATGGATTGCACAGGCAAGCAGAACTGGTGGAGTACCACAGTGGGAACATGGCAATGCAG
CGGCTAATCCTCCAGGTGGATTTGTTCATTCTGGAACCATAGACATGCCAAATGGAGGTCTTCAGGGA
TACCAAGCTGGCCCTTTTGCCAATTATTATGGGCCTCTGCCCCATTTCCACCAAAATCCTCTGAATAG
CATGCAGCATCCTGCTCTATTTAATCATATCCAAATGCAAGTACCTCATCAACATTGCCTCAGTAACA
ATTTATTGCATCACCCTTCTGGCAATGGCCTCCCCTTGGATCCAAGAATTCTGGCAATTTCATCCAAT
TCTGGGCATACCTTTGGGCCTACAGCTCAGCCATCTTTAGCAAACCAAGTTAATGCTGGGAGTTCGAG
AATTCAGCCATATGAGAATGCTCCGTTCGTGGATCTTTCGAGATTGTATGAAGCAGGAGTTATTGATG
AACATAGAGATATGCGGCTTGATGTAGACAGCATGACTTATGAGGAGCTTGTAGCGTTGGAGGAGCGG
ATTGGAAATGTTAATAGTGGTTTTACAGAAAGCTACATTGAGGAAAATTTGAAGTCAAGTTCTTATGT
CCCGGACGCTGATTGCATGCCTGATCAGTCTTCTGTGGAGAAGGATGCTTGCATAATCTGCCAGGAGG
AATATGAGGCTAAAGAACTCGTTGGAACCCTTGGTTGTGGTCACAAGTACCATGCGATGTGCATAAAA
GGGTGGCTGATGGTGAAGAACCTGTGCCCCATCTGCAAAACAACAGCTTTGCCAGCTGATAGAAGAAA
CGGATGA

SEQ ID NO: 227 - protein - Oryza sativa
MLQRNMVWTHQVASPENQVQPESFYHGGAGSNLSNLSVQVAVGVPGNTDFRSHYESINLQHQHVQNPY
PHVGVASSSVFPSTMYNPCISTTAVDRYVPPIQSFGLGNPLLLPLYHQLAQGSMDENGSSGNFCDSVR
EFIKRKNALLVGGHHFVNSFASSSSSAYVPPNPLHRSWNASFEANILPSTGVSNPPEYSSADSLNNSN
SMASHPELVHHGNYVFPAGHMSQYNAWIAQASRTGGVPQWEHGNAAANPPGGFVHSGTIDMPNGGLQG
YQAGPFANYYGPLPHFHQNPLNSMQHPALFNHIQMQVPHQHCLSNNLLHHPSGNGLPLDPRILAISSN
SGHTFGPTAQPSLANQVNAGSSRIQPYENAPFVDLSRLYEAGVIDEHRDMRLDVDSMTYEELVALEER
IGNVNSGFTESYIEENLKSSSYVPDADCMPDQSSVEKDACIICQEEYEAKELVGTLGCGHKYHAMCIK
GWLMVKNLCPICKTTALPADRRNG

FIGURE 19 (continued)

SEQ ID NO: 228 - DNA - Oryza sativa
ATGGACGCCGCCAAGGATACCACCGCCGCCGCCGCCGACCAAAACCCTACCCCCAACCCTCCCACCGC
CGCAGCTCCACCCGATGACTCCGCGGCGGCGGCGGCGGCGGGGAGACGGCCCTTCACCAGCCTCACCC
AGGAGGAGGCCGACCTCGCCCTCGCCCGCGTCCTCCAGGAGCAGGAGCGGGCGTACATGATGCTCAGC
GCGCACCACGGCGGCGACTACGCGGCCTCCGATGGTGGGAGCTACGAGTTTGACGAGGAAGGGGAGGG
GAGCGATTTTGAGGACGAGGATGGGGACGGGGACGGCGACGGGGAGGCGCTGGATGAGGACGAGGAGG
TGGCCGACGCAGACGCAGACGCCGCCGGTGACCCGGCTGAGTTGGACCCCGCGCGGTACGAGGACGAC
GAGGCCTTCGCGCGGGCGCTGCAGGACGCCGAGGAGCGCGAGGTCGCCGGCCGCCTCATGGCGCTCGC
GGGCCTCAGTGATTGGCGAGTGATGGACCATGATGATGACGATGTTGATGATGATGATGATGAGGATG
ATGATGATGATGATGATGAAGATGAAGACGGGGATGATCCACAGGATGCATGGGAAGATGTTGAT
CCAGATGAATATTCTTATGAGGAGCTGGTTGCATTGGGTGAAGTAGTTGGTACGGAAAGCAGAGGCCT
CTCTGCTGATACACTTGCTTCATTACCTTCAATAACTTATCGAGCACAAGATAAGCAAGACGGCAACA
TGGAACAATGTGTTATTTGCCGTGTGGAATTTGAGGAAGGTGAATCATTGGTTGCACTTCCTTGCAAG
CATTCATACCATTCTGAATGCATAAACCAATGGCTGCAATTAAATAAGGTATGCCCTATGTGCAGTGC
TGAAGTTCCTACTTCACAGGACACCCGGGCATGA

SEQ ID NO: 229 - protein - Oryza sativa
MDAAKDTTAAAADQNPTPNPPTAAAPPDDSAAAAAAGRRPFTSLTQEEADLALARVLQEQERAYMMLS
AHHGGDYAASDGGSYEFDEEGEGSDFEDEDGDGDGDGEALDEDEEVADADADAAGDPAELDPARYEDD
EAFARALQDAEEREVAGRLMALAGLSDWRVMDHDDDVDDDDEDDDDDDDEDEDGDDPQDAWEDVD
PDEYSYEELVALGEVVGTESRGLSADTLASLPSITYRAQDKQDGNMEQCVICRVEFEEGESLVALPCK
HSYHSECINQWLQLNKVCPMCSAEVPTSQDTRA

SEQ ID NO: 230 - DNA - Zea mays
GGACTGTACAGGACAACAGAATTTGCTGTTTTCACCGAGATCTACAGACAGCGTGACTGGAGTTTGGA
TTTCAATTCTTGCTGACGGCAGTCTTGCAAACTGGGCAAATGTTCTTCTGCGAGAGCCACTGCTTGAT
GCAGTACACATGGTAGCTATGGCCACAGTCTAGCCTTCCCATCTCTTCATTTGTTTCAAATTCTTCTT
GGCAAATGCTGCATTTTCTTTCCATTTCTGTTGCGAACCGTAAGGAACTGAAGGATGGGTGCTTGACC
TTCCGAAGGTTGCGAGTAATCTCGTCGTCACGTAACCCTGTGTTGACATATCCAATTTTGTCTCCAAG
CTCGAGCAACTCCTCGTATGTCATGTTATCAACGTCAAGGCGCCAATCCTGGTAGCGGTCATACATGT
TCATTCCTCCCAGTAACACTCTTGTCTGAAACATCCTTATCTCTTCCTCGAGTCCTCCGGCGCTCTAC
CGTGAGCCGCGGGTCCCCTGACATGNNNNNNNNNNNNNGAGATCGGCGCCGAATAAGGCGACATCGCN
NNNNNNNNNNNNNNNNGTCCATGAAGGACGAGGATATCTGCTCCTGCACGGTCACCCTCCGGGACA
AGCACGGCCTCTCTCTGTGGGNNNNNNNNNNNNNNNNNNNNNNNNNNNNNNNCAACATCTGGTGG
CGCGCCACCACGCAGTTCACGGAGGACGCCTCCGCCGCGAAGGGTATGCCGGGTGCGCACCACGTC
GGCGCCGATCCCACCGGTGACG

SEQ ID NO: 231 - protein - Zea mays
MFQTRVLLGGMNMYDRYQDWRLDVDNMTYEELLELGDKIGYVNTGLRDDEITRNLRKVKHPSFSSLRF
ATEMERKCSICQEEFETNEEMGRLDCGHSYHVYCIKQWLSQKNICPVCKTAVSKN FIGURE 19 (continued)

SEQ ID NO: 232 - DNA - Zea mays
GCACGAGCGATGGTGTTTGGGGTGTTCCTTTATCAACAAGGGGTAGAGAAGGAAGAAGGTTAATGGAG
ATTCGGAATGCACTTGAAATGATCCATAGAGGGGAGAATGTAAGGCTTGAGTCTATCTTCTATGGCGG
TGTTGACATTCACGATAGACACAGGGACATGCGCCTTGACATTGACAATATGTCCTATGAGGAGCTAT
TAGCACTCGAGGAAAGAATAGGAAATGTTGGCACTGGCCTCAGTGAGGAAGCTGTGATAAGGTTGCTC
AAACAAAGGAAATTTTCATCTTGGACACTAAAAGCATCTTTGGACCCTGAACCATGTTGTATCTGCCA
GGAGGAGTACGCTGATGGAGACGACCTCGGGAGGCTGGACTGCGGGCACGACTTCCACGCTGGCTGCA
TCAAGCAATGGCTGGTGGTGAAGAACGTGTGCCCCATCTGCAAGAGCACCGCATTGAAGAAGACCTGA
AACCCGAACAAAGGCTCGTGTCAGAGACACCCCCCATGTTTCTATGTTCACTCGATCGTTCGCGAGA
TCCTTTGCCGATTCGTATTGCTACGTTTTTTTTGGTCGGGAAAATTTTGCCAGACACCTGCATGCTAT
TGGGAAAGGAAAAGAGAGAGAAAAAGAGAGAGAGAGAGGATGCGGTTGCGGTCCTCTGTAAACTGC
TGCTGCAGTAAATAATCCCTGGAATATGTCTCCCTGCATCCAACCAAATATTTAGTAGCTGTTATAGT
GGACGCCGTANGATTAAAACCTGGAAGAGAGCCTGTTGGCTGTTGCCCACAAAAAAAAAAAAAAA

SEQ ID NO: 233 - protein - Zea mays
MEIRNALEMIHRGENVRLESIFYGGVDIHDRHRDMRLDIDNMSYEELLALEERIGNVGTGLSEEAVIR
LLKQRKFSSWTLKASLDPEPCCICQEEYADGDDLGRLDCGHDFHAGCIKQWLVVKNVCPICKSTALKK
T

SEQ ID NO: 234 - DNA - Hordeum vulgare
GAGGGAATCCGAGCCCGGAAGCGCCCCCACACCCACACCCTCCCCTCCTCCTCGCCGTCTCCTCCCAT
TCCGGCCCCGCCGCCGCGACCACGAGGCACGGCCTCCCATTCCGGCCCCGCCGGCGCTCGCGCGCTCC
CTCTCCGTCTTCCTGATCCGAGGCTTCCCGGACCGGAATGCGCCGCCGCTGTTATATTTCTTATTGAT
CCTTGCAAATCGTGGTTACAGAACTACTTGACATCGGAGAATTTTTTTCTTCTCGGTATTTAGCGAC
ATCTGGTTACATGGAGGAGTATTTAAGTAGGAGATCCAGAACAGCAATTGGGTTTCTCAGGAGAGGTT
CAGGCATAAATCGAAGCCCTGAAGAGACAATCAGTCAGAACACTGAGGTACAGGGACGCACTTCAAGA
GTCAATCCTATGAAAACCAGGCTGGTTGATAATCAGGAGAGACCCAGATATTTACATGGCTCGTATAA
ATATGCAAGCTCAAATGTCATGTCTGGAAGCTCTTCCAAATTTCCTAAGAAATTTCCCCTTAGAAAAT
TTGGTGAGGAAAAGCGAAGGCAGACTTTGTTGGAAGGGGCTGACGTTGCTGAAAGTAGTAGAAGAAAG
TCCGATGTCGGGTGTCTGGAGGGTAGTAAGAAAACCATTGTAGAGAATCAGGGTTCAGATGCTCCACA
GACTGAGACAGAAGGATTAACTGCCAAAGATGATGAACTGATAGCACCCGATCCTGAGGTTTCACATT
CTGCTGGTTCTTCAGGTATACCTGCACATACAGATGGATCCCTGATAAGGAGCGCCTCACTAAGTTCT
GAAACACATAGACAGAAGAATAAGGAATTGAATTTGGGCAGACCTGGATATTCTTGCTCTTCGTCATT
TAGTAATCAGCCTACTATACCTAGAATTCCCACCGTTGGTGCAAAGCCATCATATGGTCTTGTTAGTG
GAGAACAAAGACGTGTACCACGTGGTCTTAAAAACCTTGGTTGCACTTCAGTCTCTGATGTTCTGCCA
TCAGGATGTTCATCTGATTCTGTATATAGAATGAGCTTCGATGCTATGAGAAAGAGAGCTTCTGATGG
GGATGGCTCTTCCAGATCAAGATTCATAAGTGGACCATCCAGTTTAGGTCATTCACATACAATATATC
CTAGCATTAGTGGTCCCAGAATCAGAACTACCGAAGAATCAGTTCGGCAACAAAAATTACGAAGCCGC
AGCAGAAATATTCAGGATTCAGCAGTATCAGTAAGGACAAGACGGACTTCTCCTCGAGCACTAGGTT
CAGGATGTCCGAGGAAACAGAGGATTCCGTGCTTCATCTGAATGAGTCTAACGCCGGGAATCAACAGT
CAGTCGGTGCTGATTTTCTGTGGAAGAGGGTTCTTCAGAACGCTCCATAAGACCAGTCTCTGTGGAA
CTACCTCATGCAATTTACTCATCTAGTCGTCAGGGATCGAGTACTCGGACTGCCAGGAGAACATCGAC
CTCTCGTTTTGAGCAAAGCCCCCCACAAACATTTCGCAGTCTGGCGAGGGAAAGAGGTGGCCACAGAC
GCATAAACATGGAAGGCATTGCAGAGGTATTGCTAGTGCTGGAGAGGATTGAACAAGAAGCTGAGCTT

```
ACTTATGAGCAATTGCGGGTACTGGAGACAAATCTGTTACTTGGTGCCTTTACCTCCCATGACCACCA
TAGCGACATGCGGATGGATATTGACAACATGTCCTATGAGGAACTATTAGCATTAGAAGAGAGAATAG
GATTCGTAAGTACTGCTCTTTCTGAAGAACAGTTTGCGAAATGTATCAGAAGGCGTTTATATAGACCA
GTTGCTGCAAAGGGAAACAAAACAGCCATAGATGACATCAAATGCAGCATATGCCAGGAGGAGTTCGT
GAAGGGCGAAGAGGTTGGCAGGTTGCGGTGCGAGCACCAGTACCATGTGTGCTGCATTCGCCAGTGGC
TCCTGCAGAAGAACTGGTGCCCAGTCTGCAAAGCTCCAGCGTTGCCCTCTATGAACTGAGCCGAACAT
CATGTAGGAGCCGAGGTCTCGAACCTGTAAAATAAATTACTATGCGATGTGATGGGGTAGTCGTGGCT
CGTGGACCTGTGAATAATCTTGGCCGGGGTTCACTCCAGTTTGTGAATGTCAAATGGATTTGTGCCCT
GTGAAGTGTGAGCTGTGAAGAGTCCAGCTTGTGAATGCCAAACTGTTATCAGTTGCACTAAAGTTATA
CTTGTGTCTTTTTGCCAAAAAAAAAAAAAAAA
```

SEQ ID NO: 235 - protein - Hordeum vulgare
```
MEEYLSRRSRTAIGFLRRGSGINRSPEETISQNTEVQGRTSRVNPMKTRLVDNQERPRYLHGSYKYAS
SNVMSGSSSKFPKKFPLRKFGEEKRRQTLLEGADVAESSRRKSDVGCLEGSKKTIVENQGSDAPQTET
EGLTAKDDELIAPDPEVSHSAGSSGIPAHTDGSLIRSASLSSETHRQKNKELNLGRPGYSCSSSFSNQ
PTIPRIPTVGAKPSYGLVSGEQRRVPRGLKNLGCTSVSDVLPSGCSSDSVYRMSFDAMRKRASDGDGS
SRSRFISGPSSLGHSHTIYPSISGPRIRTTEESVRQQKLRSRSRNIQDSAVSVRTRRTSPRDTRFRMS
EETEDSVLHLNESNAGNQQSVGADFSVEEGSSERSIRPVSVELPHAIYSSSRQGSSTRTARRTSTSRF
EQSPPQTFRSLARERGGHRRINMEGIAEVLLVLERIEQEAELTYEQLRVLETNLLLGAFTSHDHHSDM
RMDIDNMSYEELLALEERIGFVSTALSEEQFAKCIRRRLYRPVAAKGNKTAIDDIKCSICQEEFVKGE
EVGRLRCEHQYHVCCIRQWLLQKNWCPVCKAPALPSMN
```

SEQ ID NO: 236 - DNA - Hordeum vulgare
```
GGAGCTCTCCCCCGTCTTTCTCTTCTCCCCTGGTCTTTGGCAGATTTTCCTCCACCCGTTCGCTCCTT
CCCTCCCTCCCTCCTCTCCTTCTCCCTACCGCCCGCCCGCATCGATCTCTCCGAATTCTGTCCCCCA
CCTAGCTGCCATCCGTCTCCCTCCACCGATTGACTGGCTTTTCCTCCGTTTCTTGGGGCTGATTCTTC
CCTCCATCTCTCTTGGCTGGAGAGGATCGGCAGGAGAAGGAACCAAGGTGGATGCCAAGAAGTTTGAT
GCCTGCTTGGAGGATTCTGGTTCTTCCGGCGAGCCGTTGAACATCTCGGGACCGGCCCCTCCCACGGT
CTCACTTGAACCGCTGGAGAAGAGGCGAGCAGCATCTGACATGCTATTGCTGCAGAACGATCTGTAGA
AGGACACCCCTTTACCCTTTCGATAATGCAAGGGCAGAGGAATTCCGTCGAACAGCTGGCTGACGTCT
TTGGATTCGACCATGGGTCTGGTTCAGGCAACCCTGTCATGGACCAGCAGGCGTACTGGAACAGCATG
CTTGGAGCAGCAGAATCTCAGAACCTCCAAGGTTACGAGATGAACCGCGGTGACGGGGCCATTCCGTA
TGGAGGCGAGGGGCATCAAGACGGACAGTTCTTGGGTTTCTGGGGGTCAGGTGAAGCTAGTTCGAGCG
GCAATGCGCTGAACATTGTGGTGGTTTGAGGATCGGTGAAAGGCGCCTGGGTGCTGAACACAGCCTT
TCTTTGGATAATGTGGATATCAACCTTAACGCCAGTGGCCATGATCTCTTTGGTCAGAGCTCAAATGC
GAATGCCACCTCTCAAGCCTCACAGCAAAATGCTGGATGTTCCCGTGCTGATACCACAGCCCAGGCTA
CTGAGCTTAGATTGCATCCTTACAGAACTTTCGGTTTAGACGACGAGCAGCCAGAGCCGTTCCCTTCT
TTGAATGCTTTCGAACATCCTTTGGGGAATTTCTCCCTGATGCCAGAGGACATTGATCAAAGACCAGG
CAGTTCCCTGGACGGCCGGCGTTTAGCGTGCAAGAGGAAAAACATTGAAGGAGTCCATGGGCAGTTTT
CAGCAGGTGCTAGCACAAGCTTTTCCCACAGAAATGATAATGCCTTCCATAGTGTTCCTTCTTCAAGT
TTCAATCCAGCTCCTGGCCCAAATGTGTCCTCTCATAACTTCTTGTTAGCTCCAAGTTCCATTGAGGA
ACAACTCCCGAACTATGGAACTACTACAGGAATGTCATCTGTTAGCTACAATCCTCCTAGTGGAGGCA
ATAACAGTTCAGGAAATTCACAGAGAAGTTTTCGGGCAAGAACTACAACCGCTCAGCAGGTTAGCCCC
TATGGTGTATGGCCCTCTTCAGGTTCTATCAGGCATCCAGGTTCATATTACCACCAGGCGCCTGCCTT
```

FIGURE 19 (continued)

```
TCAGAGCGCATTTGATGAACTAGAAGCGGCTATGCCTGTGGTCAGTGGAATCAACTTGCAATACCAGC
ATCCTGGAAATGTAGTCCCTGGCATTCCACAAACTGCACAGCGTTTCGCTGGTCGAGCAGCGGCTTCA
TCGTCGAGAGCAGGAAGTCTGGACAACATAATTCTTGGTAGAGAGGATGTGAGGAATCTTGTAGTTCC
CAGCTTCCCTAATGCTGCCCCTCACTCTGCACTAAACATGAGACATCTGGTGCCAGAATTGTCTAACT
GGAATCCTGACATTCCTGGTGCTACCATCCCTGGAAATGTGTCTTCTGTATCAAGAGCTAATGCCACT
TCAACGATTAGTCGACCAGCAGGCTCAACATCTATCGCTCATCAGAACCTGCATCGACGGCATCCTAG
AAATTTATCAGAGGAGATAGGTCGTCTATCTGGAGCGCTTCGTAGTCAGCAGCACCCGCGCTTAAGGT
CAGGGTTTCTATTGGAACGTCAGGGTGATGGTGTTTGGGGTGTTCCGTTACCAATGAGGAATAGCAGG
GAGGGAAGGCGATTAATGGAGATACGGAATGCACTAGAAATGATTCAGAGAGGGGAGAATGTCAGATT
TGAGTCTATTTTCTATGGTGGAGTCGAGATTCATGATAGACACAGGGATATGCGTCTTGACATCGACA
ATATGTCTTATGAGGAACTATTAGCACTGGAGGAAAGAATAGGAAATGTTAGCACTGGGCTCACCGAG
AACGATGTGATGAAGCTCCTGAAGCAAAGGAAATTCTCGTCGTGGAGATTATCATCTATGGAATTTGA
GCCATGTTGTATTTGTCAGGAAGATTACGTGGAAGGTGATGATCTTGGGACGCTTCACTGCGGGCACG
ACTTCCATGCCAGCTGCATCAGCCAATGGCTAGTGGTGAAGAACCTGTGTCCGATCTGCAAAAGCACC
GCCCTGAAGACCTAAGACAGCTGCAAGGCTCGTCGGTGGCACCGCAATATCATTTTATTGATTCATAA
TACCGCAACTTTTTTGGCCAAAAGGGTTTTGCATTCACCTAAAGCTCGATAAAGAAAAAATTCCAAAA
TTCCTTGAAAAAAAGTTTCAAAACTGGTCATGGTTTCAAAAACAAAGAAGGGTTCAAAACTGGTATTA
CCTGTAAGCCGCCGGGCGTGTCGCGGCAAATAATCCTGGGATCTGTGTCTAGTACTCATTTGACTAAA
TATTCATCATGGATTCGTGGCAAAAAAAAAAAAAAAA
```

SEQ ID NO: 237 - protein - Hordeum vulgare
```
MQGQRNSVEQLADVFGFDHSGSGNPVMDQQAYWNSMLGAAESQNLQGYEMNRGDGAIPYGGEGHQDG
QFLGFWGSGEASSSGNALNIGGGLRIGERRLGAEHSLSLDNVDINLNASGHDLFGQSSNANATSQASQ
QNAGCSRADTTAQATELRLHPYRTFGLDDEQPEPFPSLNAFEHPLGNFSLMPEDIDQRPGSSLDGRRL
ACKRKNIEGVHGQFSAGASTSFSHRNDNAFHSVPSSSFNPAPGPNVSSHNFLLAPSSIEEQLPNYGTT
TGMSSVSYNPPSGGNNSSGNSQRSFRARTTTAQQVSPYGVWPSSGSIRHPGSYYHQAPAFQSAFDELE
AAMPVVSGINLQYQHPGNVVPGIPQTAQRFAGRAAASSSRAGSLDNIILGREDVRNLVVPSFPNAAPH
SALNMRHLVPELSNWNPDIPGATIPGNVSSVSRANATSTISRPAGSTSIAHQNLHRRHPRNLSEEIGR
LSGALRSQQHPRLRSGFLLERQGDGVWGVPLPMRNSREGRRLMEIRNALEMIQRGENVRFESIFYGGV
EIHDRHRDMRLDIDNMSYEELLALEERIGNVSTGLTENDVMKLLKQRKFSSWRLSSMEFEPCCICQED
YVEGDDLGTLHCGHDFHASCISQWLVVKNLCPICKSTALKT
```

SEQ ID NO: 238 - DNA - Hordeum vulgare
```
TCGGCACGAGGGTGGCTTCTCGGCATCTATATATTAGAACTCCACTGGTTCTTCTCACCCCTGGCTCC
CTCCCTCCCTCTCCCCATCGAGGAATTCAATCTGGTCTCCGTCCCGGCCTGGTCCATTGGATTGGAGG
GGCGTCAGAACAGGGAAAGGCAGGCTTCACAAGGGAAGGAAGGAAGTCTCAGGTGATCCTCTGATCAA
TTGGCATGGACGAACACATGGGACGGCGGACGGTGGCGGCCTCCTCTTCACCAAGGGGGCTCCATC
CTCCTCTTCAGGGAGGACAGCTCCCGCCGCAAGGCCGGCGCTTGCTGCCCGCGCAATGGCTGCAACGG
CACCCGGCATTCGACAGACAAAGGCCGGCCAACGCCCAGCCACAGGGAAGCAGCAGCAACAGCAGCCA
AGGAAGCAGCGCCAACCACCCGGAGATCACAGCCTCTCAGGAAGAAGCCTCCACAAGGAAGCAGCAAT
CCAGCAGAGCCTTGTAGCGAAACCGACAACAGGACGGGAGAGACGGCGGCTCCAGGTGCCGGGCGTGA
CCTGCTGGCGCGCCTAAAGGACAGGGTGAATGCGTCAAGGAAGCGGTCGCTGGCCAGGGAGATGAGCA
GCTCGTCGTCGTCGTCCGGTGGGTTCAGTGCCAGTTCTTCTGGTGGTGGTGCCACCCGGTCATCAGCG
GTGTCGAGGCCGACGCGTCGTGCAGCGTCCCGGATAAGGAAGGCAGACGAAGGCGAAAATGCAGGAGG
```

FIGURE 19 (continued)

```
TGCTCGCAGGGCGCCTAGGAGGGACACCGGTGGTGGTGTTGGTGCCAGGAGGAATTCAGATGACCCGG
TGATGGTTGGGCAGCGGGCAGCAAGGGAGCAGGCCCCTACCGAAGGGTTCATCTCCGGGTTCCTGGCG
AGGTACAGGGGTAGTCTCCAGGGAGGGTCGTCTTTGCAGGACGGCACCGAGGACTCCAGCGGGTACTG
GCGCTTCGACGTCGAAGGCAGTGAAGAGCTGGAGAACTACTTCATGCTCAGTGATCGGCACCGGGCGA
TGAGGATGGACATCGACGGCATGTCCTACGAGGAATTGCTCGCGTTGGGTGACCGGATCGGCACGGTG
AACACCGGGCTTTCAGAGGACGCGCTGTACAAGTGCCTGAAACGAAGCCTGTACACGCCCACAGCCCC
AGAGACGCACCTAGACTGCGACAGAAATGCAGCATATGCCAGGAGGAGTACTCTGGTGGTGAGGAGG
TGGGGAACATGGCGTGTAAGCACTACTACCACATCACCTGCATACAGCACTGGCTCCGGCAGAAGAAC
TGGTGCCCCATCTGCAAATCCGTCGCCGCCAAGACCGTCTAGCGCTAGCACCAGCAGCCTCTGCTTGT
TTAGTGTAAACAGATTCTCCTGAAATGTCTAGACACAAGATCTGTATTCTTTTTTCTATTCTTTTCTA
GAACGAAACATTTGTTTGTGCCTTCAAGACTTCTTGTCTTCCTTCAGTTCACAAGGTCCAGGGACAAT
AAAAAGGGAACAAGAAATAAACTCTTGATTAGATGGTGGAGAATTTCACTTGCTCAGTGGTTTATCTT
GTCAGTGTTCAGTTTGTGCTCT
```

SEQ ID NO: 239 – protein – Hordeum vulgare
```
MDEHMGRRTVGGLLFTKGGSILLFREDSSRRKAGACCPRNGCNGTRHSTDKGRPTPSHREAAATAAKE
AAPTTRRSQPLRKKPPQGSSNPAEPCSETDNRTGETAAPGAGRDLLARLKDRVNASRKRSLAREMSSS
SSSSGGFSASSSGGGATRSSAVSRPTRRAASRIRKADEGENAGGARRAPRRDTGGVGARRNSDDPVM
VGQRAAREQAPTEGFISGFLARYRGSLQGGSSLQDGTEDSSGYWRFDVEGSEELENYFMLSDRHRAMR
MDIDGMSYEELLALGDRIGTVNTGLSEDALYKCLKRSLYTPTAPETHLDCDRKCSICQEEYSGGEEVG
NMACKHYYHITCIQHWLRQKNWCPICKSVAAKTV
```

SEQ ID NO: 240 – DNA – Lycopersicon esculentum
```
CTTGTGTTTCTCTCCTTCTTCTTCTTAAAATGCTTCTTCTCTGGCTCTGACACCCCCTTATTCTCTCC
CTCTCAATTTCACCCTTTTTATCTTCAATATCTTCTCTTTAGTGCTTCTCTCTCTACAAAATCAATAT
CAATTTTCTTTACAAACCCAAATCTTGAATTCTCCATTGTTGTCTTCTTTCATCTTTACAGTGCAGAG
CAACCATGCCTGTGGTATTCTCAGAAAGCTCCACGGTTTCAGAACAGATTAGATATAGAAAACCCAGA
ACGCAAACCAACAAGAAACCCAAGATATGGATCCAGTTTCTTCTTCTTCTCGCTCCACTAAACCCAC
AATTTCATCTCTACTTCTAGCACCATTTTCGCCTACAAGTCCTATCCATGAAAACTCAACTACCCCCA
GTGCCTCTACAGTTTTTTCCACTAAAAAGAAGAACTTTGCTACATTTAGGGGACTGGGTTGCACTGCA
TCACCGCAAGTGTCGGTTCCTGCTGTGATTAGGACTTCGGCTGACTGGGATTCCAAGAGAATCAAGAA
GAAAAAGCAGAACAGCAACAAGAACAAATCCCTTAATTCTGCTGTTAATGTTGGTGGAGGAGTATCCA
TTGGCTGCAGCAGTAACTCAGTCCAGAATAATAACCCTTCATCGTCGTCTTCTTCATCAGGACCATTA
TCGTTATCATCGAGCTGTGTGGCGGTTCCTGACGTTTGGTGTGGTCCTGGAATTGGATTAACTACTGA
TGCTGCTTCTGTTGATTGCGTCGTTTCAAGAAGACCCGTGTCTGGGAGGGGAAGAATCGAAAGTGACA
AAGCTACGCCTAGAGAGAGATCTGCATGTCCTATACGAAGAATGGTGAGCCCAGAAGACAACCCTTTT
CTGGATATAGAAAGTAGCCTAGGTATACCACGCTCCCAAATAGAGTTATTTGCATCTAGGCATCATCG
ACATTCTCGCCATGGTTATTCAGAAGGACTTGCAGAGATTGTGATGCTTCAAAATAGTCTTATGGGAG
GAAGAACAGATGGTCTTGATCGATACAGGAACTGGAGACTAGATGTGGATAACATGTCCTATGAGGAA
TTGCTGGAACTTGGTGACAGAATCGGATATGTCAACACAGGATTGAGAGAAGACGAGATAGCTCGATG
TGTTAGAAGAACCAAGCCCTTCTTTTGAGTAATTTATCTCTTATCCGCACAGAATTGGAAAGGCAGT
GCACCATCTGTCAGGAGGAATATGAGGCTGAGGATGAGATGGGGAAGCTGGATTGTGGACATTTCTAT
CACATTCGTTGCATAAAGCAGTGGCTGAGTCAAAAAATAGTTGCCCAGTTTGTAAATCTGCAGCTAT
```

FIGURE 19 (continued)

```
GTCTAATAGCTAGACATCAAAAAACAACTTCTCCCCTCATGAACCTTTTGGTCTGTTGTATAGCTTCT
TCTGTTATCATTACAAGCAAGAAAATTCTTTACAGAGTGTTTCTATCCTCTACTTATGTGATTACTGA
AAGTGATGGTTCTGTTGTTTGAGTGCCAATCCAATGTGGATGGATTGAAACGAGTGGTACACAAAGTA
```

SEQ ID NO: 241 - protein - Lycopersicon esculentum
```
MPVVFSESSTVSEQIRYRKPRTQNQQETQDMDPVSSSSRSTKPTISSLLLAPFSPTSPIHENSTTPSA
STVFSTKKKNFATFRGLGCTASPQVSVPAVIRTSADWDSKRIKKKKQNSNKNKSLNSAVNVGGGVSIG
CSSNSVQNNNPSSSSSSSGPLSLSSSCVAVPDVWCGPGIGLTTDAASVDCVVSRRPVSGRGRIESDKA
TPRERSACPIRRMVSPEDNPFLDIESSLGIPRSQIELFASRHHRHSRHGYSEGLAEIVMLQNSLMGGR
TDGLDRYRNWRLDVDNMSYEELLELGDRIGYVNTGLREDEIARCVRRTKPFFLSNLSLIRTELERQCT
ICQEEYEAEDEMGKLDCGHFYHIRCIKQWLSQKNSCPVCKSAAMSNS
```

SEQ ID NO: 242 - DNA - Lycopersicon esculentum
```
GATTGTCCCCTCTCTTTAGTCCACCAGGTGGTGACTTTAGATCTGTTGCTTCATCTGCTGATGTTTTG
GAGGTCTGCTTAGCGGTGAAGTTTGAGACACTGCTGTCACTACAATACTATCTTTGTCTTTTGGAGAT
TGTGAATATAGAGTTATAGGCCTAATGCAAGGGCAACGGAGTGCAATCGGATCCCTGCCAGAAACTTT
GGGTTTTACTCATGGTTCAACATCGAGTGATGGTGGTATAGATCAGCAGATATGTTGGAATAATTTGC
GAAATCCTGCACAAAATCGGCTACCAGATTATATGGTACCTTCTAATGAGACAACCATACCATTTCTT
AGTCATGCAAACCAAGAAAGGCAGAGTGTAATTGGATGGAATTTAGGAGAATCCAGCTCCTCCAATAC
ACAAAATAGTGTTAGTCGTAGTGAAAATACTACAATGAGTGCCCGTCCTGGGCCTTCTCACTTCTCTG
CTGAACAGCATTATGGGTCTTCCAATATTCTTTCATTGGGTGATGTTGAAATAAATTTGAATAACCAG
TTAGCTAACAACACTTTATTTTCTCAAGCTTCTACGTCTAGCACTGTTCCAAATGAACTAAGTAGAAG
TGCTGGACATGAGGGGCGTGATGGCGATGAAGATGATGATGATGACTGCGAAGTGATGGAGTGCACCC
CAACATTCAAGTCTAATGGACCTGGAAAAGAACGGATGTCAACCGCCAGTACTTCTTCTGATCCCCTT
GCTGGGACTTCTGCAACTAATGGGTTTCTGAGGGATGAAAGTGATGGCAGACCAGGCTGTACACTGGA
TGGTCGACGCATGGCTTGTAAGAGAAAAGCAGTTGAAGGACATCTGGGACAATCTTCGGGAAGTGGAA
GTCCAGATTATCTTCTAAACAGCTTATGGCGTTCTATACCTGCTCCAAATAATCTGACTGCAGGTGCT
AATAGCTCTGCATCAACAGAAAGTAGAAGAAACATCAATTTGCCAGCGCAGATAAATCCAAGACTTGG
GCTCACTATGGGTGGCACCACTATGGAAGGTCCGGTTGCATTGCCTGCTTCAAGGAGAGCAGAAAGTT
ACCGTAGAAATTTCAGGCTTAGGATCAATGGCTCTCATCAGCAAGTTCCTATTCCTGGCAATACGTTT
CCTACTGTGGGTAATGATAGAAATGTTACCATGTCTGACTGGGACGCATTGAGGCTGCCTTCTAATCA
GTCTTTGGATTCGAGGTCTGTTTCTGCTGCAGATAATGTAAGTCCCCGAAGCCAGCCAGTTGTGGGGC
CGGTTCCTTCTCTGCGACGAAATGCACAGAGGTGGGATTCATCTAGTTCAAGAGCTGGCAGTCCATCA
AGTTATTCTGTTTTTCTTGAGAGGAATTCTGCAGCCTATGAACAACCAAGCTCAAGAAGTGTGCCCAG
AAACATTTCGCAGCATCCAATGTTCATACCCGCTAGTGACTTGAGAAATTTGAACCAAAATCCTGTCA
ACTGGGGTTTAGCTGGTGGAAATATTTCCATTGCTGGAAATGTTGCATCTTCTTCTCGGAGTGGTCCT
AGCTCAGTAGCCCCTTCCTCTTCTCCTGGTTGGGTGGAACAAAGAAATCCTCAGCAATATCCTCGACG
ACTCTCAGAATATGTTCGTAGATCTATGTTGTCTTCAGCTGTCAGTGAACCTGGAAGTCACAATGGTA
ACACTCCGCCACATTTGAGTTCTGCTACCTCACAGGAGATGGGGCTTTCTGGCCATCCCGGGCATCGT
CCATCAAGTTCAAGGTCAGCATTGTTGTTGGAGAGACAACTCGATGGTGCAATGGGAGTTCCATATTC
CTGGAGGACTTTGGCTGCTGCCGGTGAAGGAAGAGGCAGGCTAGTTTCCGAGATTCGCAATGTGTTGG
ATCTAATGCGCAGGGGAGAGAGCTTAAGATTTGAGGACGTTATGATCCTCGATCAGTCAGGGTTCTTT
GGGATGGTGGATATTCAGGATCGCCATCGTGATATGCGTCTTGATGTTGATAACATGTCCTATGAGGA
ACTACTGGCGCTTGAGGAGCGCATAGGGAATGTCTGCACCGGGCTAACTGAAGAAACCATTTTGAATC
```

```
GTCTGAAGCAACGGAAACATGTTAGCATTAGAACAGAAGAAACCAATGATGCTGAGCCATGCTGTATT
TGTCAGGAAGAATACAAGGATGGTGAGGATCTTGGGAAGCTGGATTGTGGCCATGATTTTCATGCCGA
CTGCGTTAAACAATGGCTCATGCAGAAGAATTTGTGCCCAATTTGCAAAACAACAGGACTCAATACTT
CAGGAAAACAATGATCCATGGAAGTTTGATGTACCAGTTGGACCATGGAAGGTTGACACAAAGCGTGT
CTACGCGTTTGGTCCATGAGTTCATTCTGAGTGAGAAGATCTATGTATTTTTCTCATTAATTTTATT
CTGACCTCTGCTTAGAGGGAGTTATTTTAGAGATAGAAGAAGCACTAGCTACAATTAGGGTCATTAGG
CAAGAGTTATACATTATTTGGTTGTTTGGAAATTTACATTCTTACTTTCCAATTTATTGATACCTTTG
AATATTTTGAAAAAAAAAAAAAAAA
```

SEQ ID NO: 243 - protein - Lycopersicon esculentum
```
MQGQRSAIGSLPETLGFTHGSTSSDGGIDQQICWNNLRNPAQNRLPDYMVPSNETTIPFLSHANQERQ
SVIGWNLGESSSSNTQNSVSRSENTTMSARPGPSHFSAEQHYGSSNILSLGDVEINLNNQLANNTLFS
QASTSSTVPNELSRSAGHEGRDGDEDDDDCEVMECTPTFKSNGPGKERMSTASTSSDPLAGTSATNG
FLRDESDGRPGCTLDGRRMACKRKAVEGHLGQSSGSGSPDYLLNSLWRSIPAPNNLTAGANSSASTES
RRNINLPAQINPRLGLTMGGTMEGPVALPASRRAESYRRNFRLRINGSHQQVPIPGNTFPTVGNDRN
VTMSDWDALRLPSNQSLDSRSVSAADNVSPRSQPVVGPVPSLRRNAQRWDSSSSRAGSPSSYSVFLER
NSAAYEQPSSRSVPRNISQHPMFIPASDLRNLNQNPVNWGLAGGNISIAGNVASSSRSGPSSVAPSSS
PGWVEQRNPQQYPRRLSEYVRRSMLSSAVSEPGSHNGNTPPHLSSATSQEMGLSGHPGHRPSSSRSAL
LLERQLDGAMGVPYSWRTLAAAGEGRGRLVSEIRNVLDLMRRGESLRFEDVMILDQSGFFGMVDIQDR
HRDMRLDVDNMSYEELLALEERIGNVCTGLTEETILNRLKQRKHVSIRTEETNDAEPCCICQEEYKDG
EDLGKLDCGHDFHADCVKQWLMQKNLCPICKTTGLNTSGKQ
```

SEQ ID NO: 244 - DNA - Lycopersicon esculentum
```
GCATTTGTTTGTTGAAGATTTGTTCGTCTTCTCTATATAGTCTTTCTCCATTTTCATCAGCTTCGATC
CTATAATCTCTCTCGTGAAAAAGGGATTTTTTTTCTTTGGGATAAAGAAGAAGAAAACAACGAAAACA
GAAGAGAAAAAGATATAAATGGTGCTTCGTGTAAGACATGGATGAATATCCTGTTAAAAGAGCTGGGA
ATGGGCTTGTCGCCGCCAGAAGAGGTTTAAGGGACACTGCTGAAAACAAAGATAAAATGTTCAGTAT
TGTTCTAGACTTGGATGTAGTGGCCGGGTCAATTATACTAAGAGTACCAGAGTTGGAGGCATGGAGAA
ACCGAGACCACTAAGGCCTACTTTCGGTTCATCAAACGGAAAGGAAGTAGTTGGGAGTTCATCTGTGA
CATCCTCTGGAATGACTACTGCAAGAAGGTCAGGCAAGGAATCTCACAAGAAGTACTCTTCTAACATT
GAAGATAAGCGATCAGATACCAGTTCCTTACGTAAAGAGTCACAAGTTTTAAAACAGATGCAGTCATC
AACGGAGCGTCAATTCCAATTTGATTCAGCAAAGAGAGATACTGGATCCAGCAAAGTTGTATTTACAG
AAGTTGGTTGCTCTAGTGGAACATCGAACAGTAGACCTCGAAAAATATTTGGTCATGGACCTGGTTCT
TCCAACCAAAAGAGTCCAATGAATTCCTCTATTTCTTCGTCGTCTAAATCCATTAGTGCTGGGACAAG
GAGCAGTAGTAGTGGAGAGGGATACAGGTTGAGAAATCTGAAGTGCAATTCCACACCTGATGTCCTCC
CATATAGTTCTTCATCATCAGAATCAAGTATTAGTCGAAGGGAAACAGTAAAAGGAGAAATACTGAA
GGTGAAAGCAGTTCATCATCTAAAGGGAAAAAAATGAGTGGTGCATCGCCAAATGAAGGGCGTGCAGT
TCGTCCTGCTACTGGAATCTCCATCTCTGATTCAAGGAGTAGTAGAAGCTCGGATTTCAGTGACGGTA
ATCGTGCTGTATCAGTTCGGACCCGCAGGTCAATGAATGTGAGTACTAGGTTAAGGGGTCCTGTTCAG
GATTCATTGCATACTAAGTCTTCTGGCTTAAGCCAAAATTTACCTGAGCATGGAACTCCAAATCTAGA
TATGCCTAGTTCATCCAGTCAACTTTTCATGGATTCTTCATCAAGTGATTATAGCACATATAGTTTAC
CTGCAAATGATTATGATGATGACGACGAAGATGAAGATGAAGATGATGATTTACCTGGTGTAGTACCA
TTCACTTCAGCAGAAATCTGCATTAACGGTATGAACCGTGAAGCATTGCAGAGATATAACATGGATGG
AGTCGCTCAGGTATTGCTGGCACTTGAGAGAATCGAACAAGATGAAGAGTTATCTTATGAGCGACTAC
```

FIGURE 19 (continued)

```
TGGCGTTGGAGTCCAATTTGTTCCTCAGTGGCCTTAACTTTTATGACCAGCATAGAGACATGAGACTA
GATATTGATGACATGTCCTATGAGGAATTATTAGCACTTGAGGAGAGGATTGGCTCTGTTAGTACCGC
TCTGCCCGAGGAAGAACTATTAAAGTGCCTCAGGAGAAACATTTATCAGGGTATGGCTTCAGAAACAG
AAACACTAGAAGCTGATGAGGATGGAGATGACATCAAGTGCAGCATTTGTCAGGAGGAGTACGTGATC
GGAGATGAAATAGGGAACCTGGGTTGTGAACACGGGTATCATATGGAGTGCATAAAGCAGTGGTTTAA
GCTCAAGAACTGGTGCCCTATCTGTAAGGCTGCAGTAGAATCATCGAAACCGACATCTTAGTTGCAAA
ATGGTTAGATACCTTAAACCCCAGATGTGGGAAAGCTGTTAAACAGTTTCCCTGTGTACAAATTCATC
TGGGGTTGGTTTTTGTGGATTCCTGCAATTCATATTTACTGTTCTCTTTTTCCTCTATTCTCTTGAAC
TTTTTTTTGTCTCTTTTCTTTTGCTTAATTGCTCTCTTGCCATATGAACCAATAAACCCAGGCCTTCT
TCTGGCTTTGTGGTGGTGAATGTTTTCATATTCATTTCCTTCAAAAAAAAAAAAAAA
```

SEQ ID NO: 245 - protein - Lycopersicon esculentum
```
MDEYPVKRAGNGLVAARRGLRDTAENKDKNVQYCSRLGCSGRVNYTKSTRVGGMEKPRPLRPTFGSSN
GKEVVGSSSVTSSGMTTARRSGKESHKKYSSNIEDKRSDTSSLRKESQVLKQMQSSTERQFQFDSAKR
DTGSSKVVFTEVGCSSGTSNSRPRKIFGHGPGSSNQKSPMNSSISSSSKSISAGTRSSSSGEGYRLRN
LKCNSTPDVLPYSSSSSESSISRRETVKRRNTEGESSSSSKGKKMSGASPNEGRAVRPATGISISDSR
SSRSSDFSDGNRAVSVRTRRSMNVSTRLRGPVQDSLHTKSSGLSQNLPEHGTPNLDMPSSSSQLFMDS
SSSDYSTYSLPANDYDDDDEDEDEDDDLPGVVPFTSAEICINGMNREALQRYNMDGVAQVLLALERIE
QDEELSYERLLALESNLFLSGLNFYDQHRDMRLDIDDMSYEELLALEERIGSVSTALPEEELLKCLRR
NIYQGMASETETLEADEDGDDIKCSICQEEYVIGDEIGNLGCEHGYHMECIKQWFKLKNWCPICKAAV
ESSKPTS
```

SEQ ID NO: 246 - DNA - Glycine max
```
ATGATTAACTGTCGTGATATTATTTTTCTTTTCAATCCACACCCACCGTATAACACAAACAAGAGAGA
GAAAGAAGTGAGTCATTCGCATGAGAACCAAATTCCTGATTATATACTTTCTCCTTGTGATATGAACT
CATCCTATGACAATTCTATTATTAATCATGAATGGCAAAATTTGAGTGGATGGAGCTTAGGGGAGCCA
AGTTCCAGTAATACACCAAATGAGATCAACAATAATGAGCAAAAAGAGAACTTGGATGGTCATCAAC
CATTACTGCTGGTGCATTGGCTGGTCCAAGCCTAGAAGAAAGGCGCCTTGAACCAACCAATGCTCTTT
CACTAGACAATGTCAATACAGGTCCTATCTACATCTGTAGCCCCAATTCTCATTTGATGTCCCAGAAT
CTCAACTTAAATGCAGGTTTAGCGGACAGTGGCAGTGATGATAGTCAACATCTGGAGCTCCCTAACTT
AAACAAGTCTAGTGGGTCAGCAAACGAGTGTATACCACCTAATGTTGGATCTGGTTCTTTTCTGCTTC
CTTCTGGAAATAATGCCTTCCTGGTAGAAGATACTGATGGTAGGCCTAGTTGTTCTCTTGATACTCGG
CGGGTCTCTTGTAAACGAAAGGCTGTTGAAGGAAATAATGGACAATCGTCAGATGCTGGGAGTTCTAG
CTACAGTCAGCATACAGATGGTAGTGCATGGCACACCATTCCTACTCAGGATAATGCTGGAAGCAGTT
CGAGAAGATCTATTCCCTCAGAAGAGGTAAACGCAAGACTTGGCCTGGGTATCGGGGATGAAGCATCT
GAAAATGTTTCTGATTCAAAAACTGCAGGAAGCTCAGAAAGCTTTCACAGGAATTTCCGTTTGAGGTT
AAATCCTTCAAACCCAGCAAATTCTGTTCCTCCCACCGCATTCTCAACTGGGAGCATGATTAGGCATT
CTGGTGTTTCTCCATCCTCTCAAGTATCACAAAGACTTCATTCTGTTAATAATTCTCTGAACTCGAGG
TCGGCACCACCGATAGATAATGTGGTTCCTCAAAGCCAGCCACATGTAATCCATGTCCCTGCTTTGCC
CAGGAATAGACAATCATTTAGATGGAGTGGTGGTTCTAGCTCCAGAAACATCCATTCATCAAACTCAA
TTATATCCCCAGCCAGGGATCAGGAGGATGCAAGCTCAAGAAGAATGTCCAGAAATATGTTAGAACAT
CCAGTCTTTCAACCTGCAACTGATTTAAGAAATTTAGTTCAAAATCCAACAGTTAGAGCTTCAAGTTC
AAGTAGTGTAAATTTAAGTATTCCAGGAAATGTTGCTTCATCACGGACTGGATCAAATCCAGCTACCA
ATCCCTCATCTGCCCCAACTTGGGTTTCTCCTCCTAATCCTCCACAGCATCCACGGAGGTTATCTGAA
```

```
TATGTCCGTCGGTCCTTGTTTTCTCCCAGTTCTGATGCTATTGGAAGTCCAAGCAATAATTATTCTTC
CTTGCGCTCTGGTTTTTCTACATCTGAACCAAGGGCGTTATCATCTGGGAGTGGGGCAAACCCGAGAT
CATCTTCATGGTTGGAGAGGCAAGGAGGTAGTGAATTTGGAATTCCTTATTCACTACGTACTTTGGCT
GTTGCAAGTGAAGGAAGTAGTAGACTTGTATCTGAGGATGTTGTGATCCTTGAGCATCAATCATTTCT
TTCTGGAATAGCTGATGTTCATGATCGACACGGGATATGCGACTTGATGTTGATAACATGTCTTATG
AGGAGTTGTTGGCTCTGGAAGAGCGCATTGGAAATGTGAGTACTGGATTGAGTGAGGAAACCCTATCG
AAACTCTTGAAACAGAGAAAGCACTCGGTTGAAAAGGGTCTGAGACTGATGCAGAACCCTGTTGTGT
TTGTCAGGAGGATTATGGTGATGGGAATGATATTGGAACGCTTGATTGTGGCCATGATTTCCATAGCA
GCTGTATCAAACAGTGGCTAATGCAAAAGAATCTGTGTCCCATTTGTAAGACAACGGGCTTGGCAACA
TGA
```

SEQ ID NO: 247 - protein - Glycine max
```
MINCRDIIFLFNPHPPYNTNKREKEVSHSHENQIPDYILSPCDMNSSYDNSIINHEWQNLSGWSLGEP
SSSNTPNEINNNEQKRELGWSSTITAGALAGPSLEERRLEPTNALSLDNVNTGPIYICSPNSHLMSQN
LNLNAGLADSGSDDSQHLELPNLNKSSGSANECIPPNVGSGSFLLPSGNNAFLVEDTDGRPSCSLDTR
RVSCKRKAVEGNNGQSSDAGSSSYSQHTDGSAWHTIPTQDNAGSSSRRSIPSEEVNARLGLGIGDEAS
ENVSDSKTAGSSESFHRNFRLRLNPSNPANSVPPTAFSTGSMIRHSGVSPSSQVSQRLHSVNNSLNSR
SAPPIDNVVPQSQPHVIHVPALPRNRQSFRWSGGSSSRNIHSSNSIISPARDQEDASSRRMSRNMLEH
PVFQPATDLRNLVQNPTVRASSSSSVNLSIPGNVASSRTGSNPATNPSSAPTWVSPPNPPQHPRRLSE
YVRRSLFSPSSDAIGSPSNNYSSLRSGFSTSEPRALSSGSGANPRSSSWLERQGGSEFGIPYSLRTLA
VASEGSSRLVSEDVVILEHQSFLSGIADVHDRHGDMRLDVDNMSYEELLALEERIGNVSTGLSEETLS
KLLKQRKHSVEKGSETDAEPCCVQEDYGDGNDIGTLDCGHDFHSSCIKQWLMQKNLCPICKTTGLAT
```

SEQ ID NO: 248 - DNA - Glycine max
```
ATGCAAGGGCAGAGAGGTACAGTTGTTTCAATGCCTGAAACCTTAGAATTTGATTGTGGATCTGCATC
TGGCAATTCTACTGCGGATCCGCAAATTTGCTGGAATAATGTGAATCCTGCAGAGAATCAAATTCCTG
ATTATATACTTTCTCCTTGTGATATGAACTCATCCTATGAGAATTCTATTATTAATCATGAATGGCAA
AATTTGAGTGGATGGAGCTTAGGGGAGCCAAGTTCTAGTAATACACCAAATGAGATCAACAATAATGA
GCAAAAAGAGAACTTGGATGGTCATCAACCATTACTGCTGGTGCATTGGCTGGTCCAAGCCTAGAAG
AAAGGCGCCTTGAACCAACCAATGCTCTTTCACTAGACAATGTCAATACAGGTCCTATCTACATCTGT
AGCCCCAATTCTCATTTGATGTCCCAGAATCTCAACTTAAATGCAGGTTTAGCGGACAGTGGCAGTGA
TGATAGTCAACATCTGGAGCTCCCTAACTTAAACAAGTCTAGTGGGTCAGCAAACGAGTGTATACCAC
CTAATGTTGGATCTGGTTCTTTTCTGCTTCCTTCTGGAAATAATGCCTTCCTGGTAGAAGATACTGAT
GGTAGGCCTAGTTGTTCTCTTGATACTCGGCGGGTCTCTTGTAAACGAAGGCTGTTGAAGGAAATAA
TGGACAATCGTCAGATGCTGGGAGTTCTAGCTACAGTCAGCATACGGATGGTAGTGCTTGGCACACCA
TTCCTACTCAGGATAATGCTGGAAGCAGTTCGAGAAGATCTATTCCCTCAGAAGAGGTAAACGCAAGA
CTTGGCCTGGGTATCGGGGATGAAGCATCTGAAAATGTTTCTGATTCAAACACTGCAGGATGCTCAGA
AAGCTTTCACAGGAATTTCCGTTTGAGGTTAAATCCTTCAAACCCAGCAAATTCTGTTCCTCCCACCG
CATTCTCAACTGGGAGCATGATTAGGCATTCTGGTGTTTCTCCATCCTCTCAAGTATCACAAAGGCTT
CATTCTGTTGATAATTCTATGAACTCGAGGTCAGCACCACCGATAGATAATGTGGTTCCTCAAAGCCA
GCCACATGTAATCCATGTCCCTGCTTTGCCCAGGAATAGACAATCATTTAGATGGAGTGGTGGTTCTA
GCTCCAGAAACATCCATTCATCAAACTCAATTATATGCCCAGCCAGGGATCAGGAGGATGCAAGCTCA
AGAAGAATGTCCAGAAATATGTTAGAACATCCAGTCTTTCAACCTGCAACTGATTTAAGCAATTTAGT
TCAAAATCCAACAGTTAGAGCTTCAAGTTCAAGTAGTGTAAATTTAAGTATTCCAGGAAATGTTGCTT
```

```
CATCACAGACTGGATCAAATCCAGCTACCAATCCCTCATCTGCCCCAACTTGGGTTTCTCCTCCTAAT
CCTCCACAGCATCCACAGAGGTTATCTGAATATGTCCGTCGGTCCTTGTTTTCTCCCAGTTCTGATGC
TACTGGAAGTCCAAGCAATAATTTTTCTTCCTTGCGCTCTGGTTTTTCTACATCTGAACCAAGGGCGT
TATCATCTGGGAGTGGGGCAAACCCGAGATCATCTTCATGGTTGGAGAGGCAAGGAGGTAGTGAATTT
GGAATTCCTTATTCACTACGTACTTTGGCTGTTGCAAGTGAAGGAAGTAGTAGACTTGTATCTGAGGA
TGTTGTGATCCTTGAGCATCAATCATTTCTTTCTAGAATAGCTGATGTTCATGATCGACACAGGGATA
TGCGACTTGATGTTGATAACATGTCTTATGAGGAGTTGTTGGCTCTGGAAGAGCGCATTGGAAATGTG
AGTACTGGATTGAGTGAGGAAACCCTATCGAAACTCTTGAAACAGAGAAAACACTCGGTTGAAAAAGG
GTCTGAGACTGATGCAGAACCCTGTTGTGTTTGTCAGGAGGATTATGGTGATGGGAATGATATTGGAA
CGCTTGATTGTGGCCATGATTTCCATAGCAGCTGTATCAAACAGTGGCTAATGCATAAGAATCTGTGT
CCCATTTGTAAGACAACGGGCTTGGCAACATGA
```

SEQ ID NO: 249 - protein - Glycine max
```
MQGQRGTVVSMPETLEFDCGSASGNSTADPQICWNNVNPAENQIPDYILSPCDMNSSYENSIINHEWQ
NLSGWSLGEPSSSNTPNEINNNEQKRELGWSSTITAGALAGPSLEERRLEPTNALSLDNVNTGPIYIC
SPNSHLMSQNLNLNAGLADSGSDDSQHLELPNLNKSSGSANECIPPNVGSGSFLLPSGNNAFLVEDTD
GRPSCSLDTRRVSCKRKAVEGNNGQSSDAGSSSYSQHTDGSAWHTIPTQDNAGSSSRRSIPSEEVNAR
LGLGIGDEASENVSDSNTAGCSESFHRNFRLRLNPSNPANSVPPTAFSTGSMIRHSGVSPSSQVSQRL
HSVDNSMNSRSAPPIDNVVPQSQPHVIHVPALPRNRQSFRWSGGSSSRNIHSSNSIICPARDQEDASS
RRMSRNMLEHPVFQPATDLSNLVQNPTVRASSSSSVNLSIPGNVASSQTGSNPATNPSSAPTWVSPPN
PPQHPQRLSEYVRRSLFSPSSDATGSPSNNFSSLRSGFSTSEPRALSSGSGANPRSSSWLERQGGSEF
GIPYSLRTLAVASEGSSRLVSEDVVILEHQSFLSRIADVHDRHRDMRLDVDNMSYEELLALEERIGNV
STGLSEETLSKLLKQRKHSVEKGSETDAEPCCVCQEDYGDGNDIGTLDCGHDFHSSCIKQWLMHKNLC
PICKTTGLAT
```

SEQ ID NO: 250 - DNA - Zinnia elegans
```
CCGGAAGATTTAACTATGTGGACTGTAGGTGAACCTGGTTCAAGTTCAGAACCTTCATCAAGTTTGCT
TTCTTTGGGTGACCGTGGTTCATCCAGCTCATCATTTTCTGACCCGTTTGGACCGTCTTCTGATCCAT
TTGAGTTAGAGGCCCGTCAAGTCACTCGTAAAAGAAAAGCAGTTGAATTAACTATTGGGCAGTCTTCT
TCTGGTGTCGGTAGTTCAACCATGTTTCAAGGATCTGAAGGTGGTCCTCCTGCAGACCCGACTATCCC
TCGACTTGGGCTGAGTATCGGCGAACACCCTGTTGTGGAAAACACTCGCAGAAATGTTGGTTTGAGGA
TTAATTCTGCCCGTCAACAAGTTGACGCGTTGCCCGCTAATAACGCCAACCGGGAATCTGATGTTTCG
GTTCTGAGACTTAATACGCCAGCCGAGAGTTCATTAACTCATCAGGGTCAGCCTGTCTTACGGGTTCC
TGCATTACGAAGAAATTTCCAATCAACTTCAAGATGGAGAGCAAGCCGATCAGCAAATGTTGCTATGT
CAGGTGCTCGGAACGAGGTCGATTCGATTTCCGATCATCCTCTATTTACACCGCCAAGTAATGCAACA
ACCCCCTCCCAAACCGAACTCAACTGGAGTTCAAACAGTGGTGGAAATGGACCGAGTTCTGGGTCTTC
AACAAGTCATCATTCTCGAAGACTATCGGCATTCCTTCGGAGGTCTTTGTTGCCGGTTGCTGATCCAG
AGGATGGTGTAGGACAAAATGGTAATATTTTCCCAAGAGTTCCTCCGGCTTTGAGTGGTTCATCTTCT
TCTTCTCAAGACGTTGGAGTTCCGCCAGGTCAGCATAATCAACCGCTCTCGAGATCGTCTTTGTTGCT
TGGCAGACAGCTCGAGGGAGTGTTTGCTTTCCCACATCATTCACGGACAGCGACACCCAACAGTGAAG
GAAGAGGCAGACTAGTGTCAGAGATTCGCCAGATTCGCAATGTACTGGATCTTATGCGCAGGGGTGAA
CCTTTGAGGTTTGAGGATCTTATGATCTTAGATCAATCGGTGTTCTATGGTGTTGCGGATATACACGA
TAGGCACCGAGATATGAGGCTCGATATAGATAATATGTCATATGAGGAGCTACTTGCATTGGAAGAAC
GCATAGGAAATGTGAACACTGGTTTGACCGAAGAAACAATTTTAAAGCATATCAGGCAGAAACAGTAC
```

FIGURE 19 (continued)

```
GTGGTTGGAAACGGGTCAGCCCGATGCAGACCTTGCTGCATATGTCAGGAGGAATACAAGGATGGAGA
CGATCTCGGAACGCTCGACTGCACGCATGACTTCCATTATGGTTGCATCAAACAATGGTTACAACAAA
AGAACTTGTGCCCGACTTGTAAGTCGACCGGGTTTGCGTCTACTTGAACAGAAACGGCCCGTCATGAA
GATTATATGGTTTCTTGGATCGCAAGTAACTTAGTAAGGTGTTGTCTTTGGGTAAACTGTTGGCAAAT
GGTATTCTTTGCCTGTTACATTGTTAGAGATTTATTTATGTTACTTTATTGTATTCTTTTTTCATGAT
GAACCAAAGGCACAACTCATGTTAAGTT
```

SEQ ID NO: 251 - protein - Zinnia elegans
```
MWTVGEPGSSSEPSSSLLSLGDRGSSSSSFSDPFGPSSDPFELEARQVTRKRKAVELTIGQSSSGVGS
STMFQGSEGGPPADPTIPRLGLSIGEHPVVENTRRNVGLRINSARQQVDALPANNANRESDVSVLRLN
TPAESSLTHQGQPVLRVPALRRNFQSTSRWRASRSANVAMSGARNEVDSISDHPLFTPPSNATTPSQT
ELNWSSNSGGNGPSSGSSTSHHSRRLSAFLRRSLLPVADPEDGVGQNGNIFPRVPPALSGSSSSSQDV
GVPPGQHNQPLSRSSLLLGRQLEGVFAFPHHSRTATPNSEGRGRLVSEIRQIRNVLDLMRRGEPLRFE
DLMILDQSVFYGVADIHDRHRDMRLDIDNMSYEELLALEERIGNVNTGLTEETILKHIRQKQYVVGNG
SARCRPCCICQEEYKDGDDLGTLDCTHDFHYGCIKQWLQQKNLCPTCKSTGFAST
```

SEQ ID NO: 252 - DNA - Lotus japonicus
```
TATTGCTGCACACAACCGCTTGCTTTATTTCATTGTCTCCTTCTTTCTTTCTTTCTTTCTCAGAACAA
GAACAACCCTCTTCTTCTGTTTCTGCTTCTCTCTGTAACTTTCTCTCTCATCATCTTGCGTGTTCAAG
ATCGTTACTCAACCGTCATCGGATTCTCACCGATTCACAAGGCAGGTTTCTTTGTGCTGTTGATCTGT
TGTACATGATTACATCTGCATGCACTGATTGTGATTATTTGCACATCTGACTCAATTAGTCTATTTTG
ACTCCCGGGGATTGCAAGTAACAGTTATGGGGCATAGACATTTGTATAACACAACCCCATTGTTTGAG
GGTGAGCCTGACCAGAATTGGAATCATATGCATACTGATCAACATTATGTGAACCTTGGTAGGACTAG
CACTGCAGAGAATGGTTCCTATTTTTATCCTGTGGAAAATGTGTCCATAGATAGCACTTCTTTCCCCT
CTCATTGGAACCCTGCAACAAGGTCAAATGGATATGCATCTTCAAGTCTCAACATTGAAGTACCTCCT
CATCAATCAGATACATCAGGCGCTTCAAATGATCATTTTATACATTCGTCTAGTGCTGGAGCTTTCTT
TGCAGTATCTAATAATTGTGTGCCTCAGCCGCCTGCGGCCAATTATGACAGACCACCATTTCAGGTTG
ATGGTGGTTTTATTGATCTTACGATGGGAAGTGGACGAGGGCCTCACAAGCGAAAGAGCCCTGGAATT
CCATCAGTCTATGAGAGAGGCGGTTCAAGCAGATATTTCAATGCTGGGAGTTCAACTGATGTTCCTAT
ATCTTCAGAATCGCGGCCCGAGAAGCCAAATATAGATTCTAATATATGCCCTGGGATCATGTTCCTA
TGACATCCACAGTCAGAGGTGCAGGCCACTCAATAAAGGGTGAGAGTTCTTTGAGGAATGTGAGGAGC
CGTTCTGCACTTGATTTGGAATCCAACCTTTCTAGGACCCATTTACCAAGTAATCATTCGCACAACTC
CTACTCTACTATCCCACCAGTTGACCATTCTAGCATGATGGATCTTTCAGGTCAGATTTCTACCTCTT
TGACAGGGGATTGGAGCCAAATGAACATATCTCCTGCTAATGGAAGGGTGTTATTACCAGATGCCGGT
GCTTATGGTCTTGAGTCAAGTCACTTCCTTGCTGGAAGTGGTGCTACTGCTAGTAATGCTTCTGTTGA
TGTTGGGAGCTTCCATCATGAATTTGGTACAAGCAGAAATCCTACTGGTCCTCAAAGTTTTCATAATC
TGACTCAGACTGCTAGGGGAATCCGAAGTAACTATTCTCAGAGATCAGCCCCTACTTTTAGGGCTTCT
TCAAGCACGCACTTGGGACATGTGACACCATTGGATGATGGATTGCCCATGGTAGCTGAAAGTTACTC
TTCTAGACATCAAAGGCCATTATCCAGCATTGGATGGCGGAACAGTGATCGAAATGGGAGGGCAAGAA
TTTCTAGTGAAAGATATCGATCATTGGCTAATGAGGCCGGTCTCCATGGTCGAATTTCCCCTGAGGTT
TTCATGATTGTCGATCGCGCATCAATGTATGGTTCAAGGAATATGCTTGACCAGCACAGAGACATGAG
GATGGACATAGATAACATGAGCTATGAGGAACTACTTGCACTTGGTGAGAGGATTGGCCATGTTAACA
CGGGATTATCCGAGGATTCGTTTTCCCAGTGTATGACAGAAACAATATATTGTTCATCTGAGCAAGGT
CAAGACGAAGGAAGCTGTGTAATCTGTCTGGAAGAATACAAGAACATGGACGATGTTGGGACACTTAA
```

```
AACTTGTGGACATGATTACCATGTGAACTGCATTAAGAAGTGGTTATCTATGAAGAAACTATGTCCTA
TCTGCAAAGCTTCTGTTATGCCCGAGGATAAGATGAACAAATAAATAAATTATACTGTAGTATGATTA
ATCTCACTCTGTATATATATTTGGACATCCTTCAAAGTGGAGGAAACAGACTTGCTTTTAGAGAAGTT
GAACAGGACTGCTACTGTGTTCATGTATTTATTTTAGTCTTTGAATTCAATTAAAAAAAAAAA

SEQ ID NO: 253 - protein - Lotus japonicus
MGHRHLYNTTPLFEGEPDQNWNHMHTDQHYVNLGRTSTAENGSYFYPVENVSIDSTSFPSHWNPATRS
NGYASSSLNIEVPPHQSDTSGASNDHFIHSSSAGAFFAVSNNCVPQPPAANYDRPPFQVDGGFIDLTM
GSGRGPHKRKSPGIPSVYERGGSSRYFNAGSSTDVPISSESRPEKPNIDSQYMPWDHVPMTSTVRGAG
HSIKGESSLRNVRSRSALDLESNLSRTHLPSNHSHNSYSTIPPVDHSSMMDLSGQISTSLTGDWSQMN
ISPANGRVLLPDAGAYGLESSHFLAGSGATASNASVDVGSFHHEFGTSRNPTGPQSFHNLTQTARGIR
SNYSQRSAPTFRASSSTHLGHVTPLDDGLPMVAESYSSRHQRPLSSIGWRNSDRNGRARISSERYRSL
ANEAGLHGRISPEVFMIVDRASMYGSRNMLDQHRDMRMDIDNMSYEELLALGERIGHVNTGLSEDSFS
QCMTETIYCSSEQGQDEGSCVICLEEYKNMDDVGTLKTCGHDYHVNCIKKWLSMKKLCPICKASVMPE
DKMNK SEQ ID NO: 254 - DNA - Arabidopsis thaliana
ATGGATAGGTGGTCCAGTAAAAGAGCCATGGAGGCGAGACCTGACTCTAAGAAGAAGGGTGGTGTTGT
TTTTAGAGATAGATTTAACAGCAATAGTTGCAAGGTTCCTATTTGTAGTGATGAGAAAAAATCAATGA
ACTTTACTAGGTTTGTTGGCTCTTCAGATAAGAAAGAGAAATCAGTGTTGTCTACATACCGCTCTTCG
CCAAACGGGAAGGAAGTAATTGGAACTTCCTCTAAGATTTGTATCTCTAGCTCCTCTTCTGTGAAAAG
TGGTGAGAAGCAACCGTTTTCTCAGATAGCCATTGATTCATCAGAGAGCAGCAGAGGTAGTGAAGACG
AGGTAGAGTCAGAAATCTTGCAAGTTCCTCTTGGAAGAGATAAAAGAAGAATGAACAATAAACTTATT
TATGGAAAAGTTATAACACCTGAAGCGGAATGCTCAAAGTTGCCATCAAGCTCAAGAATCAAGAGAGG
TTTTAGGCAGAGATTTGGGTTGAGCAAGCAAGAGTTTCATCCTGGTCCATCTGGCCAGTCAACATCTG
CTAACCGGGGATGCAGCCCGTTGTTGTCAGGTGTCATTCCAAGTGGTTTTGGATTGGACAAAAGATTA
AGTCGGAAGGCAGATACAATCAGTAAGACAAAAGTTTACGGAGAAAGCAGTTCTAGCTCCTCAGCTAG
GGGGAAGAATGTAACAGAACCTCCACCAGTTGAAGTGAGACGTCGTAGTTTTAATCCGAGAGGTTCTG
TTTCTGATAGTAGACGGGCTAGACACTGCATTTTGGATGATGACAACGATGTTGCTTCAGTTGGGAGT
CAGAGATTGGCAAATAGAAATAATAGTCGCATTAGAGGGAGTGGTAGAGACGGTTATCCTCTGTCAC
GGCAGCAGAGATGTCTCAGACTGAAACATCAAACAATCTCAATTCTCCTGTCTCTTTGGAGCTGTTCT
CTGGTTTTCCAGAATTTGGCCTCTCTGGTTCCTTATTGAGTCATGACAGTTTTCGCAGTTATAATTTA
GATGGGATCTCCGAGATTCTGCCAGAACTTGATAGGATCGAACAAGATATCGAACTTAATTATGAGGA
TCTGCTTATCATGGAAACAGGTTTACTTCTCGGTGGACTAAGCTTCCATGACCAACACCGAGACATGA
GGCTAGACATCGATAACATGTCATATGAGGAACTATTAGCTCTAGAAGAGAGGATTGGTACAGTAAGC
ACTGCTTTGACAGAAGAAGCAATATCAAAGTGCTTGAAAACAAGTATCTATCAGATGAAACCTTTGAG
TTATGGGTCTATCACCAAAAGTCCTAGTGATAACAAGGAAGATGCCAAATGCAGCATCTGCCAGGAAG
AATATACGATTGGAGATGAAGTTGGGAGGCTACACTGTGAGCACACATACCATGTGAAGTGTGTGCAA
GAGTGGTTGCGGATAAAGAGTTGGTGCCCAATCTGCAAAGCCACAGCCGAAACCTCCTCTAAATAA
```

FIGURE 19 (continued)

SEQ ID NO: 255 - protein - Arabidopsis thaliana
MDRWSSKRAMEARPDSKKKGGVVFRDRFNSNSCKVPICSDEKKSMNFTRFVGSSDKKEKSVLSTYRSS
PNGKEVIGTSSKICISSSSSVKSGEKQPFSQIAIDSSESSRGSEDEVESEILQVPLGRDKRRMNNKLI
YGKVITPEAECSKLPSSSRIKRGFRQRFGLSKQEFHPGPSGQSTSANRGCSPLLSGVIPSGFGLDKRL
SRKADTISKTKVYGESSSSSSARGKNVTEPPPVEVRRRSFNPRGSVSDSRRARHCILDDDNDVASVGS
QRLANRNNSRIRGSGRDGLSSVTAAEMSQTETSNNLNSPVSLELFSGFPEFGLSGSLLSHDSFRSYNL
DGISEILPELDRIEQDIELNYEDLLIMETGLLLGGLSFHDQHRDMRLDIDNMSYEELLALEERIGTVS
TALTEEAISKCLKTSIYQMKPLSYGSITKSPSDNKEDAKCSICQEEYTIGDEVGRLHCEHTYHVKCVQ
EWLRIKSWCPICKATAETSSK

SEQ ID NO: 256 - protein - Arabidopsis thaliana
ATGGGACAAAGAAATAGGAATGTTGATTTAGAAATGGAGCAGCAGCAATCTCAAGCTTCTCTCCAAGC
AGAGCCTTGCATCCTTTTAGGCAGCTTTCCGCAACAACCGGATAATAATAATATGCCTGCTATGGTTG
CACACGTTCCTAATTTAGAACCTCATTCTCTTCAAGACCCAACTTATGACAACTCGGCCATGTTCTAC
GGGCTTCCTCAGTATCATCATCATCCTCACCAGCGTGTTCCAACGAATTTCTATGTTCCCTATGTGGC
ATTTCAGGCTCCTCCGGGTCAGTTACCATCTTCAAGCAGTCACGGTGTAGTTGGTGTAAGTCCTGATC
ATGAATACGAAAGAAATGCTCATTTTATGGATCACACAAGAGGGACATACAAGCGAAAGAACGCTGAA
GGAATACCCGGACAACCTCAATATTTAAGTACCTTAGCAGCTCCATTTAACACACCGGAGACAATAGC
CCCTTTTGGAGGCGCTAGGAACAGACCAGGAGCTGTTACAGTGAACACTGTTCTTCCTTCTCATGCTC
CAAACAACTTCATTCAAGGAAACTATGCAGGTCATCATCCTTTTCCACCTCCTGGCTCAATGTGGTAT
GATCAACACCACGGCAGATCTGATGGCTCACCTTCGTTCTGGCCCACACCTTACATGCACGGTAGTAA
CATTTTCGCTGGTTCCATAGAGTCTAGTAGCAGAAACCCTACATCATTTATGTATCCTTCTCAGTTAA
ACCCGAGGGACCACTATTATAGTCATCATCACCACCCGGCACCTCCTCCTGTACAAGGCATGAGAGGC
CAGAATGCCACATTATATCCCCACACAGCTTCTTCTGCTTCATACAGAGTTCCTCCAGGGAGTTTTAC
TCCTCAGAACACAATGAATAGTGGTCCCTTGGGGTCAGAGATGGGCTCGAGTCACATGGGTCCGGTTC
AACCAACCGGGTTTCGGATATACCAGCATCATCAGCGAGATGATTCTGTACCTGTAGCAACTCTTAGA
CAACACCGTGGAGGAGTTCCTCGGCTTAGAGTGATGCCTGATGATGAAGTTGCGCTTTTGGAGTTTGG
AGACTTCCTTGGTGGTTCTGGAAATAATCACATTGATCATCATCGAGATATGCGATTGGACATCGAGG
AAATGTCTTACGAGGAGCTTCTTGCTTTGAGTGAGCGAATTGGAACAGTAAACACTGGGTTGCCGGAG
GAAGATGTTAAGAATCATTTGAAAACAAGAACATGTTCTGGAATCAACTTTGAAAAGAGTCGTCGTC
CCCACGAACTAAAGATTTAGAAACCGAACCGTGCACTATATGTCAGGAAAGCTTCAAGAACGAAGAAA
AGATTGCGACTTTGGATTGCGGGCACGAGTATCATGCAGAGTGCTTGGAGAAATGGCTGATTGTGAAG
AACGTTTGCCCAATCTGTAAATCAGAGGCACTGGTCATGGAGAAGAGAAAGGTATAG

SEQ ID NO: 257 - protein - Arabidopsis thaliana
MGQRNRNVDLEMEQQQSQASLQAEPCILLGSFPQQPDNNNMPAMVAHVPNLEPHSLQDPTYDNSAMFY
GLPQYHHHPHQRVPTNFYVPYVAFQAPPGQLPSSSSHGVVGVSPDHEYERNAHFMDHTRGTYKRKNAE
GIPGQPQYLSTLAAPFNTPETIAPFGGARNRPGAVTVNTVLPSHAPNNFIQGNYAGHHPFPPPGSMWY
DQHHGRSDGSPSFWPTPYMHGSNIFAGSIESSSRNPTSFMYPSQLNPRDHYYSHHHHPAPPPVQGMRG
QNATLYPHTASSASYRVPPGSFTPQNTMNSGPLGSEMGSSHMGPVQPTGFRIYQHHQRDDSVPVATLR
QHRGGVPRLRVMPDDEVALLEFGDFLGGSGNNHIDHHRDMRLDIEEMSYEELLALSERIGTVNTGLPE
EDVKNHLKTRTCSGINFEKESSSPRTKDLETEPCTICQESFKNEEKIATLDCGHEYHAECLEKWLIVK
NVCPICKSEALVMEKRKV FIGURE 19 (continued)

SEQ ID NO: 258 - DNA - Arabidopsis thaliana
ATGGGGCACAGACATTTTCTTGGTTCATCCCAGTTTTTTGATGATGAACATGATCAAGGCTGGAATCA
TACACACCCAGAACATCCATATTCGAGTCAAGCAACATCTGGGACCAGTGAGAACAGATCACATGTTT
ATCCAGCAGAAAACATGTTGAATGAAGGAATGCCAGTGTCTTCTCATTGGAACTCTTCTCCAGGACCA
AATGCTTATACTGACTCAGGTCATAGTGTGGAGAGACCACACTACAATCCGGGGGTTTCGGGGCCGTC
CCATGATCCTTCCGTGAATTCAACAGTTCCAACTTTCTCTGCTCCACATGAGAATTATGTGACATTTG
CATCTTCTTCAAGCTACAACAGCCAGACATGGTCAAATGCTAGTTATGTTGATCATCAATCTATGGAA
AGTGTGAGAGGAGCACAAAAGAGAAAACGACCATGTCCTTCTTCCATCTATGAAATGGGTAGTTCAAG
CCAATATCACGGTGACAGAACTCCTGCAGACACTCATTTCCCCTCGGAATTGCACTTGGGAAAATCAA
TAACGCATGATCATGACCCTCATTACATGCCATGGCTTATGAACCCAACTTACAGAAGTAATAATCTC
TCGATCAGGGGAGAGAGCTCTTCAAGGAATGTCCGGAGTCGTCCTACACTTGATTCAGAGACCAGCTT
AGGTAGAAATAATTTGCCAAGAAGCTTGAGCCTTGATTCTCATTCTACACACCACCACAGTGTTGATC
ATTATGGCTCAGGTCAATTTCCTGGTCAGACATCTCACGGAAATAAAGACTGGAACTGTGCTAGATTG
TCCCCAGTTCTTAGAGATATAAATGGCTTTAGTCCAGAGACAAATAATTTCCTTCCTGCAAGAAGTGT
TGTCAACAGCTTATCTGTTAATACTTCCGGCTATCATCACCATGAGCTTACCGGAAACAGAAACCCTA
CAGTTTCCCACGGGGTTCCTGGAACTTCAACACTATCTACAAGCAGCAGCCGCTTCTCTCATAGGTCA
ACATCCACCTATAGATCTTCTTCACACGGTTCGCGATCGGGACATGTAGCATCTTCTTCTGGAGACAG
GTCTCATTTGGTCACTGAGACTTATCCGTCTAGGCATTTAAGGCCACCACCACACATTTCATGGCGTA
GCGGTGATCGGCCAGGGAGACGCAGAAGTTCCTATGAGAGGTTTCAGCCTCCTTTCGATGAAGTTGCT
CTCCACGAACGGTTTTCATCTGAGGAATTCATGGTTGAAGATCGCCAACCACAATACTACGGATCCAG
AAACATGCTTGATCACCACAGAGACATGAGGCTTGACATCGATAACATGAGCTATGAGGAACTCCTTG
ATCTTGGAGAAAGGATTGGGAGTGTCAACACTGGTCTATCCGACAGCGCAATCTCCAGTTGCTTGTTA
GCAACAATGTATTATCCATCATATCAAACAGAGGAGCAAAGAAAATGTGCAATCTGCCTGGAGGAGTA
CAAGGAAAAAGAAGAGTTAGGGGAAGTTAAGGGGTGTGGTCATGACTACCATGGGAGGTGCATCAAGA
AATGGTTGTCTATGAAGAACTCTTGCCCTATTTGCAAATCCCCTGCTTTACCTGATGCTTCTAAGAAC
TCATCATAA

SEQ ID NO: 259 - protein - Arabidopsis thaliana
MGHRHFLGSSQFFDDEHDQGWNHTHPEHPYSSQATSGTSENRSHVYPAENMLNEGMPVSSHWNSSPGP
NAYTDSGHSVERPHYNPGVSGPSHDPSVNSTVPTFSAPHENYVTFASSSSYNSQTWSNASYVDHQSME
SVRGAQKRKRPCPSSIYEMGSSSQYHGDRTPADTHFPSELHLGKSITHDHDPHYMPWLMNPTYRSNNL
SIRGESSSRNVRSRPTLDSETSLGRNNLPRSLSLDSHSTHHHSVDHYGSGQFPGQTSHGNKDWNCARL
SPVLRDINGFSPETNNFLPARSVVNSLSVNTSGYHHHELTGNRNPTVSHGVPGTSTLSTSSSRFSHRS
TSTYRSSSHGSRSGHVASSSGDRSHLVTETYPSRHLRPPPHISWRSGDRPGRRSSYERFQPPFDEVA
LHERFSSEEFMVEDRQPQYYGSRNMLDHHRDMRLDIDNMSYEELLDLGERIGSVNTGLSDSAISSCLL
ATMYYPSYQTEEQRKCAICLEEYKEKEELGEVKGCGHDYHGRCIKKWLSMKNSCPICKSPALPDASKN
SS

SEQ ID NO: 260 - DNA - Arabidopsis thaliana
ATGGATGGATTTAAGGGTAAAAGAACATCTAGACCGATTATGCCACGGAAAGCAAGTGGTCTTGTGTT
ACATGAGAATATGAAGAAGAAAGATGATAAGAGTGTTGTCCCTATCTGCAGTAGAATTGGTTGCAGTT
CCAGGGTTAGTTCCACTAAGGGAGATTTGATTGATCATAAAGCAAAAGCTACTGTGTCTTCGTTTCGA
TCTCCTTTGAGTGGAAAGGAAACCGTTGGTAGTTCATCTCGAAGTATGAGTGGATTTGGTGGTACAAA
AAAGGCTTCCAAGGTTATTGGTAGGAGACAACTCTCTTCTCTTTTGGACATGGATTCTTCAGAGAGCA FIGURE 19 (continued)

```
GCAGTGTTAATGAAGACTCACCCACAAGTGAGCGTTCCCTTCCTCGTGGAAAGACAAAAGAAAGCACT
ATTAGTGTTCATTCTGAAAGTAGTGTCTCTGGAGAAGTTGTGACAGAGGCAGGAAGCTCGAGTAGAGG
AACTGGTAGAAGCATTCATCAGAGACCTGATTTGGTCTCCCGAGATGCTCGTGTGAGTAATAGTGAGC
AAAATGCAAGAGCTAGTGTGAACAAGAATGGATTAAGAGACTTGAGGAACAAATCTGGTTCTGATGTT
CTTCCATCTAATTCAACTCCGACAAGAAAAGTAACATCTTTAGAAAGAAAACCTCTGATGGTGAGAG
CAGCTCTTCGAGTAGAGGGAATAAGACGGAAGGATCAGTGGTTGGGGGAAAGAATATTAGTTCCCCTC
AGGGGAATGGCATCACCATGTCTGAACCTAGGAGGAACAGAAACTTACCAAGTGTTAGGGACAACAGT
GTTGTTTCAAGTAGTACTAGGAGATCAACTGGTTATTATGGTAGAACAGGACGTGCTGGAGCGGTTGC
AACACTACAAGCACCTCGGCCTCCAACAAGAGCTGATCTCAATCCTTCTAGATCGGCAGAAGCTTCGC
GTAGTCCTTTAAATAGTTACAGTAGGCCAATCAGTAGTAATGGCAGGTTACGTAGCCTGATGATGCCT
GGTAGCCCCTCAGAAGCCGGCCTTTCTCGCTCTTTGATGAACCGTGATACTTTCAGACGGTATAACAT
GAATGGAGTTGCAGAGGTATTGTTGGCCCTGGAAAGGATTGAGCAAGACGAAGAGCTTACATACGAGC
AATTGGCTGTTTTAGAGACCAATCTGTTCTTAAATGGTATGAGCAGCTTCCACGATCAGCATAGAGAT
ATGAGGCTTGACATTGACAACATGTCGTATGAGGAACTGTTAGCATTAGAGGAGAAAATGGGTACAGT
GAGCACTGCTCTAAGCGAAGAAGCGCTTCTGAAAGCCTCAAGTCAAGTATTTACCGTCCAAACGATG
AATCCGACGACATTTGCCTGAACAAAGATGATGATGTCAAGTGCAGCATTTGCCAGGAAGAGTATGTT
GATGGAGATGAAGTAGGGACTTTGCCTTGCCAACATAAATACCACGTGAGCTGCGCGCAACAATGGCT
ACGGATGAAGAATTGGTGTCCTATATGTAAAACCTCTGCAGAATCTCAGCCACATCCATTTTCATGA

SEQ ID NO: 261 - protein - Arabidopsis thaliana
MDGFKGKRTSRPIMPRKASGLVLHENMKKKDDKSVVPICSRIGCSSRVSSTKGDLIDHKAKATVSSFR
SPLSGKETVGSSSRSMSGFGGTKKASKVIGRRQLSSLLDMDSSESSSVNEDSPTSERSLPRGKTKEST
ISVHSESSVSGEVVTEAGSSSRGTGRSIHQRPDLVSRDARVSNSEQNARASVNKNGLRDLRNKSGSDV
LPSNSTPTRKSNIFRKKTSDGESSSSSRGNKTEGSVVGGKNISSPQGNGITMSEPRRNRNLPSVRDNS
VVSSSTRRSTGYYGRTGRAGAVATLQAPRPPTRADLNPSRSAEASRSPLNSYSRPISSNGRLRSLMMP
GSPSEAGLSRSLMNRDTFRRYNMNGVAEVLLALERIEQDEELTYEQLAVLETNLFLNGMSSFHDQHRD
MRLDIDNMSYEELLALEEKMGTVSTALSEEALLKSLKSSIYRPNDESDDICLNKDDDVKCSICQEEYV
DGDEVGTLPCQHKYHVSCAQQWLRMKNWCPICKTSAESQPHPFS SEQ ID NO: 262 - DNA - Arabidopsis thaliana
ATGCAGGGGGAGAGGGCCAGTCTTGGCTATTTATCAGAGGCCTTGAACTTTGAGCATGGTTCTTCTTC
AAGTAATGGTGTGATAGATCATTGGGAGAATATTCACAGTCTTGGTGATAATGACTTGCAGGATTACA
TGATTGCAAATTCTGAATCAAATACTTCGCTTGCAAACTCAGTTTATCACGAGCAACAGGGTTTACGC
AGATTTAGCCTTGGTGAGGCTAGCTCTAGTGGCACGAAGGATGAAGCTTCCAGTCACAATGAGCAACG
AATGGAAACAAGATGCTTTGACGGACGAGGAAATGAAATAATTGATTTAGACCCAGTGTTTGCGCAGC
CATCAGGCACAAATCAACCTGTTCAGAATGTCAATCTGAATGCAGAGTATATAGAAATTCACGAGGAT
ATTAATCCATATAGAGGTCGGTCTGGCTTCATAGAAGCTAATGGACCAGGGACCAGGGTCTCACAACC
TGGCAGATCTTTTGAAGAGAACGGTGTTGGAACAGGTTCTTCTGTAGAGGGACGTCGTGCATCCTGCA
AAAGAAAAGCTCTTGAAGGCAGTATTAGTCAATCTTCTTCAGGAGGTTATCATGATTTCCAGCGTGGA
GAAAGCAGTTCGTGGACCCCAGGTTCTACGGTTTTAGGCCAGGAAATGGTTTAAACATATCTGGCTC
CCTTGACAATGGACCAAGAGGAATGGTCTCCGGTACTGTACCAAATTTTCCTGTTTCTGCACCAAATT
TTCCTGTTTCTGCCATTGCAGAGAGCTCCAGTAGAAATATATGCGTCAGGAGTAATCCCTCAGATCAT
CAAGAAACTGTAAACCCATCTACCTTTGCTGCGGGAACTGTTGTCAGGCGGCCTGTCCCTCCATCCCA
```

```
GTTGAACTTGTCAAGACACTTACCAGCAGATCAGCATTCATTGGACTTGAGACCTGGACAGTCTTTTG
TCGTTTCTCGTAACCCAAATTCTACTCCTGTGAGCATACCACCTGGTTCAAGGACTATGCTACCACCA
TTTCGGTGGACTGGGAGCTCACTAGTGGGTGGAACATCGAACTCTACTGCGCCCGTTGAGAGAAATCT
TCATCTAGATGAAACCAGGTCAAGAAGCATACCCGGGAATACTCTTGAGATTCCCATGTTTGCAGCTC
CTGAGGTAGGAAATTTTGCCCGTAGTCAGAGTAGCAGAAATGTAACAAATGGAAACCTGAATAGTGCA
TCATCAGTGTCCAGGACAGGCTCAACAACAAGTGTTCCACCACCACCACCACCATCTTCTAATCTAGC
GTGGACTTCTTACCAGAATTCACCACATTATCAAAGAAGAAGGACTGAAAGGTCTGAACTTGCACGTA
GGTCCTTGCTTTCTTCCCTTGCAGCAGATGCTACAAACCAGAGATCTGGTGATCATCCAACACTTCGT
TCGTTGGCCCCTCCTGCCTCTTCGGATGGGCTTGTGCTTCAGCCTGGTGGTGATAATAGTCAGATGCA
TAATCGGGCTTACTCGAGAGCAGGTCCGTTGTTTGATAGGCAAGGGGATAGTGTGGTTGGTATTCCTC
ATCCTTTGCGGGCCTTGGCAGCTGCAAGCAGAGGAAGAAGCAGACTTATGGTGTCCCAGATGCAGAAT
GTCTTGGATGTCATGCGTAGGGATGCTAATAATAACAACTTGCGGCTTGAGGACGTTATGCTTCTAAA
TCACTCAGTACTATTTGATGGGGCTACTGGTCATGACCGGTATAGAGACATGCGACTTGATGTGGACA
ACATGTCATATGAGGAATTGTTGGCACTAGAAGAGCGGATTGGAGATGTTTGTACCGGTGTAAACGAG
GAAACCATATCAAACCGGTTAAAGCAACGAAAATACAAAAGCAACACAAAATCTCCACAAGATGCAGA
GCCATGCTGTGTTTGTCAGGAGGAATACACCGAAGGAGAAGACATGGGGACACTAGAATGTGGGCATG
AATTCCATAGCCAATGCATTAAAGAATGGCTGAAACAGAAGAATCTTTGCCCAATCTGCAAGACTACA
GGCTTGAACACCGCGAAGAAGCGGAGGATAGCATGA
```

SEQ ID NO: 263 - protein - Arabidopsis thaliana
```
MQGERASLGYLSEALNFEHGSSSSNGVIDHWENIHSLGDNDLQDYMIANSESNTSLANSVYHEQQGLR
RFSLGEASSSGTKDEASSHNEQRMETRCFDGRGNEIIDLDPVFAQPSGTNQPVQNVNLNAEYIEIHED
INPYRGRSGFIEANGPGTRVSQPGRSFEENGVGTGSSVEGRRASCKRKALEGSISQSSSGGYHDFQRG
ESSSWTPGSTVFRPGNGLNISGSLDNGPRGMVSGTVPNFPVSAPNFPVSAIAESSSRNICVRSNPSDH
QETVNPSTFAAGTVVRRPVPPSQLNLSRHLPADQHSLDLRPGQSFVVSRNPNSTPVSIPPGSRTMLPP
FRWTGSSLVGGTSNSTAPVERNLHLDETRSRSIPGNTLEIPMFAAPEVGNFARSQSSRNVTNGNLNSA
SSVSRTGSTTSVPPPPPPSSNLAWTSYQNSPHYQRRRTERSELARRSLLSSLAADATNQRSGDHPTLR
SLAPPASSDGLVLQPGGDNSQMHNRAYSRAGPLFDRQGDSVVGIPHPLRALAAASRGRSRLMVSQMQN
VLDVMRRDANNNNLRLEDVMLLNHSVLFDGATGHDRYRDMRLDVDNMSYEELLALEERIGDVCTGVNE
ETISNRLKQRKYKSNTKSPQDAEPCCVCQEEYTEGEDMGTLECGHEFHSQCIKEWLKQKNLCPICKTT
GLNTAKKRRIA
```

SEQ ID NO: 264 - DNA - Arabidopsis thaliana
```
ATGCAAGGTCCACGAAGCACTGGTGATTCATCGACTGGAATAAATTATGCAGATGGAGAACCCATCTG
TAGCACCAATTCAGAGACTACTTCCAATAACATCCTGAATCCAGTGGATGTTCAGTTTCCAAACAATA
CTACAGGTTCAGGACGACCAACTTACGCAAGCTCTAGCTCGCATGTTGTTCAAAATCATAACTGGTGG
AGTTTTGGTGAATCCAGCTCTAGATTGGGGCCTTCTGATCATTTAAATTCCAATGGTTCAAAGACTGA
TCGACAGCTTCTCTCAGATGGCTATGGATTTGAGGAAGGGCAATCAGGTATGTTGTTACCTGGAGAGT
CCTTTTTGCGTGGGTCAAGCTCTAGTCATATGTTAAGTCATGTAAATCTGGGCAAGGACATGGACATT
GGTAGTGGTCTGCAGACTTCTGGGGTCGTTATCCGCCATAATAACTGCGAGACTTCATTGGGAAGCTC
AAGTCAAACCGCAGAGGAGAGAAGCAGTGGTCCAGGTTCTTCGTTGGGTGGTCTAGGTTCATCCTGCA
AAAGAAAGGCTCTTGAAGGAGCTCCTAGCCATTCTTTCCCTGGTGAAAGTCATGGTTGCTTTTTTCAA
ACTGAGAATGGTGCTTGGAATGAGGGTCTTGCTCAATATGATGCTTCAAGTAGCTTAAGTTTGTCTAT
GCCCTCACAAAATTCTCCAAATGTTAATAATCAGTCTGGTCTACCAGAACCAAGATTTGGATTGGGTG
```

```
GTGGGAGAGCAGTTACAGCAAGTGCTTTTCCTTCTACAAGAAGCACGGAAACCATCTCTAGACCTGGC
AGGCGGTTAAATCCTGGGCAGCCACCAGAGTCAGTTGCATTCAGCTTCACACAGTCCGGTAGTTCTGT
GCGTCAGCAACAGCAGTTACCAGCAACTTCTCCTTTTGTTGACCCTCTGGATGCAAGAGCAATACCAG
TTACAGGTAGCTCAAGCAGTGGTGATGGTCAGCCAAGTATGATCCACCTTCCTGCATTGACAAGAAAT
ATACACCAATTTGCTTGGAGTGCTTCGTCTAGTTCGAGAGCAAACAGTATGCCTGAAGAGGGATTGTC
ACCATGGACGCGCCAAGAATAAACTCAGAGCAGCCAGTCTTTACTACACCTGCAAATGAAACGAGAA
ATCCAGTGCAGGATCAGTTTTGTTGGAGTTTCACTCGTGGAAACCCTAGTACATCTGGAGATTCTCCC
TTTGTTCCTCGAGCAGGATCGAGTTCAGGGATCCATGGTTTGCAGCCGAATCCCACTTGGGTTACTCC
CCATAATCAATCAAGAATATCAGAAGTTGCTCCGTGGTCTTTATTTCCTAGTATCGAATCTGAATCTG
CTACTCATGGTGCTTCTCTTCCATTACTACCCACAGGGCCTTCTGTTTCCTCGAATGAAGCTGCAGCG
CCGTCTGGATCTAGTAGTCGTAGTCATCGCTCTCGACAAAGAAGATCGGGATTATTACTGGAAAGGCA
AAATGATCATCTCCATTTGCGTCACTTAGGAAGAAGCTTAGCTGCTGATAATGATGGAAGGAACCGGC
TGATTTCCGAGATACGGCAGGTGTTGAGTGCCATGCGAAGAGGGGAGAATTTACGGTTTGAGGATTAT
ATGGTATTCGATCCACTGATCTACCAAGGTATGGCCGAGATGCATGATAGGCATCGGGATATGCGTCT
TGATGTTGATAACATGTCATATGAGGAGCTATTGGCACTTGGGGAACGCATAGGAGATGTGAGCACTG
GTCTAAGCGAAGAGGTGATCCTGAAAGTAATGAAACAGCACAAACATACATCATCCGCTGCTGGCTCT
CACCAGGACATGGAGCCTTGCTGTGTCTGTCAGGAAGAGTATGCAGAAGGAGATGATCTTGGAACACT
GGGATGTGGTCATGAATTTCACACTGCCTGCGTCAAGCAATGGCTGATGCTCAAGAATCTCTGCCCAA
TTTGTAAGACTGTGGCTTTATCGACATAA
```

SEQ ID NO: 265 - protein - Arabidopsis thaliana
```
MQGPRSTGDSSTGINYADGEPICSTNSETTSNNILNPVDVQFPNNTTGSGRPTYASSSSHVVQNHNWW
SFGESSSRLGPSDHLNSNGSKTDRQLLSDGYGFEEGQSGMLLPGESFLRGSSSSHMLSHVNLGKDMDI
GSGLQTSGVVIRHNNCETSLGSSSQTAEERSSGPGSSLGGLGSSCKRKALEGAPSHSFPGESHGCFFQ
TENGAWNEGLAQYDASSSLSLSMPSQNSPNVNNQSGLPEPRFGLGGGRAVTASAFPSTRSTETISRPG
RRLNPGQPPESVAFSFTQSGSSVRQQQQLPATSPFVDPLDARAIPVTGSSSSGDGQPSMIHLPALTRN
IHQFAWSASSSRANSMPEEGLSPWDAPRINSEQPVFTTPANETRNPVQDQFCWSFTRGNPSTGDSP
FVPRAGSSSGIHGLQPNPTWVTPHNQSRISEVAPWSLFPSIESESATHGASLPLLPTGPSVSSNEAAA
PSGSSSRSHRSRQRRSGLLLERQNDHLHLRHLGRSLAADNDGRNRLISEIRQVLSAMRRGENLRFEDY
MVFDPLIYQGMAEMHDRHRDMRLDVDNMSYEELLALGERIGDVSTGLSEEVILKVMKQHKHTSSAAGS
HQDMEPCCVCQEEYAEGDDLGTLGCGHEFHTACVKQWLMLKNLCPICKTVALST
```

SEQ ID NO: 266 - DNA - Arabidopsis thaliana
```
ATGCAGGGAGAGAGGGCTAGTCTTGGTTCTTTATCAAAGGCTTTGAACTTTGAGCGCGGTTCTACGTC
TAGTAACGCTGTGGTAGATCAGCAAATTCGTTGGGAGAATCTTCACAATTATGGTGATAATGATTTGC
AGGATTACATGAGTTCAGCTGCTGATACAAATCCTACTTTTGCAAACTCAGTTTATCATGAGAAACGG
GGCTTGCAGAGGTTTAACATTGGTGAGGCTAGCTCTAGTGGGACGAAGAACGAAGGGGCAAGTCTCAC
TGAACAATGGAAGGGAATTGGAAGGTTTGAGGAACAGAGGAATGATAAGCTTGAGTTGAGCCCTTTGT
TTGTGCAACCATCTAATGGAAGCCGCGTGGTTCGTGATGTCAATCTAAATGCAGAATACAATGAGCAT
CTTGAGGATATGAATCCGGTTACAGTTCATCCTGGTCATTTTGAGGTTAATGGACTTAGGTCTGAGTT
TTTACTAGATAACAGTGTTAGAGCTGGTTCCTCTGTTGATGGACGTCGTGCATCCTGTAAAAGAAAG
CTCTTGATGCAAGCGGTGGTCAGTCCTCTTCAACTGGAGGTTTCCGTGAGTTCCAGCGTGGAGTATCC
AGTTCTTGGATCTCAGGTCCTACGTATTACAGCCCAGCAATGACAGCAAATGATTTAAACATATCTCT
TGATCATGGTCGAAGGGGTTTGGTATCTAGCGCTGTTCCAAATCTATCTCCTCCTACCATCACAGAGA
```

FIGURE 19 (continued)

```
GCTCTAGTAGAAATTACCCTGTCTGGGTTAATCCCACATATCAACAAGAAACCGTAAGCAATTTTGCT
CCATCCTTGAACTCACCAGGGCTTATACCTGCAGATCACCAGCAGATCAGCATGAGATATGGACATGC
GTTAGGCAATTTTGCATCTCAGAACCCAAATGCTCCTGCTACTCATATGCCCCCTGTTTCAAGAAATA
CATTTCAATGGAACACAAGCCCCGTGGCAGCGGTTATATCATCTAGTTCTGCTACTCCTGTTGACAGA
AATGTTATTCATCGAAATGCAACCAGACAAAGAAGTAATACTCTAGAGATTCCCTTGTTTGTCCCAGC
TCCTGAACTGAGAAATGTGGCCCATGGTCATATTAGCAGAAATGCAAGTGGTGCTAGACATGTTGCAT
CGTCTTCATCCAGGACAAGTGTTCAGCCATCACCGTCAGTCCAGCATTGACTCCTTACCAGAATAAC
TCACTACATAATCAAAGAAGATTATCTGAAAACTTTCGTAGGTCATTGCTTTCTTCCCTTGTTACACA
GCAGAGGCTGCTCGTTCATTGGCCCATCCTGCCTCTCCAAATGAGCACGTGCTTAATCGGTGGTG
ATAACACCTCTCAGGTGCATAATCGAGCTTCCTCGAGAGCAGGTCCAAGACAAGGGCAAGATGCAACT
GGCATTTCTCATTCTTTGCGAGGCTTGGCATCCACAAGTCGAGGAAGAACCAGAATGGGGCATCCGA
GATCCGTAACATCTTGGAGCACATGCGTAGAGCAGGGAACTTGCGTTTGGAGGATGTTATGCTTCTCA
ATCAGTCCATAATGCTAGGTGCGGCTGATATTCATGACCGATATAGAGACATGCGACTTGATGTTGAC
AACATGACATATGAGGAGCTGTTGTCTCTAGAAGAACGGATTGGAGATGTTTGTACCGGTTTGAACGA
GGAAACCATATCAAACCGATTGAAGCAGCAGAAGTACAAAAGTAGTACTAGATCTTCACAAGAAGTAG
AACCATGCTGTGTTTGTCAGGAGGAATATAAGGAAGAAGAAGAAATAGGAAGGCTGGAATGTGGACAC
GACTTTCATAGTCAATGCATCAAAGAATGGCTGAAGCAGAAGAATCTTTGCCCGATTTGCAAAACAAC
AGGATTAAACACTGCAAATAAGCCACAAAGATAA
```

SEQ ID NO: 267 - protein - Arabidopsis thaliana
```
MQGERASLGSLSKALNFERGSTSSNAVVDQQIRWENLHNYGDNDLQDYMSSAADTNPTFANSVYHEKR
GLQRFNIGEASSSGTKNEGASLTEQWKGIGRFEEQRNDKLELSPLFVQPSNGSRVVRDVNLNAEYNEH
LEDMNPVTVHPGHFEVNGLRSEFLLDNSVRAGSSVDGRRASCKRKALDASGGQSSSTGGFREFQRGVS
SSWISGPTYYSPAMTANDLNISLDHGRRGLVSSAVPNLSPPTITESSSRNYPVWVNPTYQQETVSNFA
PSLNSPGLIPADHQQISMRYGHALGNFASQNPNAPATHMPPVSRNTFQWNTSPVAAVISSSSATPVDR
NVIHRNATRQRSNTLEIPLFVPAPELRNVAHGHISRNASGARHVASSSSRTSVQPSPSSPALTPYQNN
SLHNQRRLSENFRRSLLSSLVTQQRAARSLAHPASPNEHVLQSGGDNTSQVHNRASSRAGPRQGQDAT
GISHSLRGLASTSRGRTRMGASEIRNILEHMRRAGNLRLEDVMLLNQSIMLGAADIHDRYRDMRLDVD
NMTYEELLSLEERIGDVCTGLNEETISNRLKQQKYKSSTRSSQEVEPCCVCQEEYKEEEEIGRLECGH
DFHSQCIKEWLKQKNLCPICKTTGLNTANKPQR
```

SEQ ID NO: 268 - DNA - Arabidopsis thaliana
```
ATGAATCCAATGCAAGGGCCACGCAGTATTGGTGGTTCGTCTACTGAAGTGAATCAAGTAGATGGTGA
ATCGATTTATTGCACAGAGACGTCTTTGAATACCATGTTGAATCCAGCAGACACTGGATTTCCAAACA
ATAGTACACCTTCAGGACGACCAACTTATGCAAGTTCGAGTTCTCATGCTGCTCAAGATCATACCTGG
TGGAGGTTTGGGGAATCCAGCTCCATACCAGGTCCTTCTGATCAGGTCAATTCCATTGGAATAAAGAC
AAGTCACCAGCTGCCTCAAGATGGTACTCACCACTTTGTTGGCTATGGATCTGAGGGAAGGCAAACAG
GTCTGAATGGTATGATGGTAGATGGAGGGGTTCATGCTGGCAGTCACATCAGGAATGTGCCGTCTTTC
TTGCGCGGTTCAAGTTCTAATCCTATGCCACAGCATGTAGATATGAGTATGGACATGGACAGCGATAA
TTGTAATGCACAGACTTCCGGGGTAGTTATCCGTCATAATAGCTATGGGAGTTCATTAGGAAGCTCAG
TTCAGGCCGCTGGGGAGAGCAGCAGTGGTCCTGCTTCTCCATTTGGTGGTTGGGGTTCGTCTTGCAAA
AGAAAGGCTCTTGAAGGATCCCCTAGTCATTATTTTCTGGTGAAACTCCTAACCGCATTGTTCAGAC
TGAAAATAGTGCTTCGCATGCAAGTCTTTCTCAATATGGTGCTTCAAGTAGCTTAAGTTTGGCTACAC
CTTCACAAAGTTCTCCAAATGTTACTAATCATTTTGGCCGGACAGAACAAATGTTTGGATCTGGTGGT
```

FIGURE 19 (continued)

```
GGAAGAGCAGTTGCAGCCAGTGCTTTTCATTCTACAAGAAACACTGACACCTTATCTAGAGCTGGCAG
ACGATTAAATCCCAGGCAGCCTCAAGAGTCTGTAGCATTCAGCGTATCACATGGTGGGACTTCTGTAC
GTCCCACTGGTTCTTTGCAACAGAACTTACCATTAAACTCTCCTTTTGTAGATCCTCCAGATGTGAGA
TCATCATCAATTACTAGTGGCTCAAACACTGGTGAGAATCAGACAAATATAGTCCACCTCCCAGCTTT
GACCAGGAATATACACCAATATGCTTGGGATGCTTCTTTCAGTTCTAGAGCCAGTAATCCTTCGGGTA
TTGGGATGCCTGCAGAGCGATTAGGACCACAGTGGGAAACACCGAGAAGCAACCAAGAGCAGCCCTTG
TTTGCACCTGCAACTGACATGAGACAGCCGGTGCATGATCTTTGGAATTTCGCACGTGGAAGCCCTGG
TTCATCTGTAGATTCTCTCTTTGTTCCTCGAGCAGGGCCGAGTTCAGCTATTCATACGCCACAGCCTA
ATCCCACATGGATTCCTCCTCAGAATGCCCCACCACATAATCCATCGAGAACATCAGAACTTTCTCCT
TGGTCTTTATTTCCTAGTATTGAATCTCCATCTGCTAGTCATGGTGGCCCTCTTCCATTATTACCCGC
AGGCCCTTCTGTTTCCTCAAATGAGGTGACAATGCCATCTAGTTCTAATAGCCGAAGCCATCGCTCAC
GGCATAGAAGATCAGGTTTGTTATTGGAGAGACAAAATGAACTTCTCCACTTGCGTCACATAGGGAGG
AGCTTAGCTGCTGACGGTAATGGAAGGAATCAAATCATTTCTGAGATACGTCAGGTGTTGCATGCCAT
GAGAAGAGGAGAAAATCTACGGGTTGAGGATTACATGGTGTTCGATCCACTTATCTACCAGGGTATGA
CTGACATGCATGATAGGCATCGGGAAATGCGGCTTGATGTGGACAACATGTCGTATGAGGAGCTATTG
GCACTTGGGGAACGCATAGGTGATGTGAGCACTGGCCTAAGTGAAGAGGTCATTTTGAAAGCAATGAA
ACAACACAAACATACATCTTCGTCTCCTTCTTCTGTTGAGTTGCATCAGAACATAGAGCCATGCTGCA
TTTGTCAGGAAGAGTATGTAGAAGGTGATAATCTAGGAACCTTGAAATGTGGACATGAATTCCACAAG
GACTGTATCAAGCAATGGGTCATGATCAAGAATCTCTGCCCCATTTGTAAGACCGAAGCATTAAAGAC
GCCGTAG
```

SEQ ID NO: 269 – protein – Arabidopsis thaliana
```
MNPMQGPRSIGGSSTEVNQVDGESIYCTETSLNTMLNPADTGFPNNSTPSGRPTYASSSSHAAQDHTW
WRFGESSSIPGPSDQVNSIGIKTSHQLPQDGTHHFVGYGSEGRQTGLNGMMVDGGVHAGSHIRNVPSF
LRGSSSNPMPQHVDMSMDMDSDNCNAQTSGVVIRHNSYGSSLGSSVQAAGESSSGPASPFGGWGSSCK
RKALEGSPSHYFSGETPNRIVQTENSASHASLSQYGASSSLSLATPSQSSPNVTNHFGRTEQMFGSGG
GRAVAASAFHSTRNTDTLSRAGRRLNPRQPQESVAFSVSHGGTSVRPTGSLQQNLPLNSPFVDPPDVR
SSSITSGSNTGENQTNIVHLPALTRNIHQYAWDASFSSRASNPSGIGMPAERLGPQWETPRSNQEQPL
FAPATDMRQPVHDLWNFARGSPGSSVDSLFVPRAGPSSAIHTPQPNPTWIPPQNAPPHNPSRTSELSP
WSLFPSIESPSASHGGPLPLLPAGPSVSSNEVTMPSSSNSRSHRSRHRRSGLLLERQNELLHLRHIGR
SLAADGNGRNQIISEIRQVLHAMRRGENLRVEDYMVFDPLIYQGMTDMHDRHREMRLDVDNMSYEELL
ALGERIGDVSTGLSEEVILKAMKQHKHTSSSPSSVELHQNIEPCCICQEEYVEGDNLGTLKCGHEFHK
DCIKQWVMIKNLCPICKTEALKTP
```

SEQ ID NO: 270 – DNA – Arabidopsis thaliana
```
ATGTCTTCTACAACAATCGGCGAGCACATCAGACTCCGACGAGCTAGAAACCAAACAATCCGTCATCT
CCACGCCGCCGACGATGATCCGCCGCTAAGCCACGTCGTTCTTCCGATTTCACAACCTAATCGCTTCT
GTAACTCCGCAATGTCTTCCTTCTTTCCCCTCCCGACTTCCTCCTCCAACGAAAGCACGAGGAAGAAA
CCGTACCAAACGTCGTCGTTTCGAGGGATGGGTTGCTATGCCGCAGCAGCAGCAGCAGCTCAAGAGGT
TTCTGTTCCCTCCGTCATTCGCTACTCCGCGGATTTGGATGCCAGAATTAGAAAAGATAAGAAGAAGA
AGAAGCATAAGCATAAGAAAAAGAAAAAGAAGAATAAGGAAGCTACGAAGATGGTTCGATTAGGATT
TTAAGCGAAGAAGCTAGAGACGTTATTGATGTTTGGTGCAGACCTGGATTAGGCTTCTCCACGGATGC
TGTAATTGGTCGATCGGTTGATCCTCCTCGGGGAAGGAATATTCCGTCGTCTCGTCGCAAAATTGATG
TGGATAACAACAATTATAATCACACACTGGGTTCTTCTGTTCTTCCCATTCGGTTTCTCAATCAAGAA
```

FIGURE 19 (continued)

```
ACTCATTCTCATGATATCTTCAACTCTGATTCTACTTTTGTGACATCATCACGCGCTGAACCAACGAT
GTTGTCAAGTAGATGTCGTGGCCATCTTCCACGCTCTTACCCTGATGATCTTACCGAGATGAGGATGC
TCCAGAATGGTTTTGTAATGGGAAGAATAACAGATTCCCGTGATAACTACCACGAATTGAGGCTCGAT
GTTGATAGCATGTCATACGAGCAACTTCTTGAGCTTGGTGATAGAATTGGTTATGTGAATACTGGACT
AAAAGAAAGCGAGATACATCGTTGTCTTGGGAAAATCAAACCATCCGTATCACATACTCTTGTTGATA
GAAAATGTAGCATCTGTCAGGATGAGTATGAGAGAGAGGATGAGGTTGGGGAATTGAACTGTGGACAC
AGCTTTCATGTCCATTGCGTGAAACAATGGCTTTCGAGGAAGAATGCTTGTCCGGTCTGTAAGAAGGC
AGCATATGGCAAGCCTTAA
```

SEQ ID NO: 271 - protein - Arabidopsis thaliana
```
MSSTTIGEHIRLRRARNQTIRHLHAADDDPPLSHVVLPISQPNRFCNSAMSSFFPLPTSSSNESTRKK
PYQTSSFRGMGCYAAAAAAAQEVSVPSVIRYSADLDARIRKDKKKKKHKHKKKKKKNKGSYEDGSIRI
LSEEARDVIDVWCRPGLGFSTDAVIGRSVDPPRGRNIPSSRRKIDVDNNNYNHTLGSSVLPIRFLNQE
THSHDIFNSDSTFVTSSRAEPTMLSSRCRGHLPRSYPDDLTEMRMLQNGFVMGRITDSRDNYHELRLD
VDSMSYEQLLELGDRIGYVNTGLKESEIHRCLGKIKPSVSHTLVDRKCSICQDEYEREDEVGELNCGH
SFHVHCVKQWLSRKNACPVCKKAAYGKP
```

SEQ ID NO: 272 - DNA - Arabidopsis thaliana
```
ATGGATGGATGTGCTGGTAAACGATCTGTTGACCGGTTGGTTGTGCCTCGGAAAGCCAGTGGTCTTAC
CCTGCGTGAGAATATGAACAAGACAGATGGTAAGAATGTTCCTTTCTGCAGCCGAGTTGGTTGTACTG
CAAAGGTAACTTCTACCAAGAGATCTCGGATTGGCTCTACGGATAACAATACAAAAGTTGGTCTGCCT
CCGGTTCCATCTACCTTAAATAGAAAGGAAATTGTTGGGAGCTCATCTCGTACTCCTGGTGGATTTGG
ATACTTGAGAAAGCCAGCCAAAGTTACTGCAAGAAGACAGCCGTCATCTAGTTTAGACACTGAATCTT
CGGAAACGAGTTGTATTCATGATGATCCAGCTGCAACAGAGCCCACACTTCCACGCCAAAAGACTAAA
AGAGTCACAATCAATGTTCATCCTCAAAGCGCTGTCTCTAGAGAAGTTGTAATAACAAAGGCAGGAAG
CTCAAGTAGAGGAACCAGCAGAATTAGTCATCCAAAGTCTGAATTGGGTACCCGCGATGCTCTGACGG
GTCCTTCTGTTTCTACATCTTCTGGTAACAGTGAGCACACTGTAAGAGGCGGTTTGAGTAGGCATAGA
TTGAGGAACTTGAGCTGCAATTCTGTGTCTGATGTTCTTCCAACTAACTCAAACTCAGCAACAAAAAT
CAGTGTGACTAAAAAGAAAAACGCTGATGGAGAGAGCAGCTTATCTAGCAAAGGTAGTAAGACTAGTG
TGTTGGTTCCAAAGGTAAGGAATCAAATTTCTTCTCATGGCAATGGCGTCACAGTTTCTGATAACAGA
AGAAATCGAGTAGTACCAAGTATTAGGGACAGCAGTACTGTTGTTTCAAATGGTTGTAGGAGAGCTGG
TTATTTTGGTAGATCAGAGCGACTTGGAGCTACTGCATCCTCTGCTACTTCTCGACAAATGCCTCATC
CTACAACACCAACCGATCCCAATCCTTCTCTTTCGTTTTGTCCATCAAATATATACAGTAGTACTGGA
CGCGTACATAGCAATATGCCTGGTAGCCCCACGGAAGCTGACCCTTCAAGCTCTTTGGTGAACCGGGA
TGGTTTGAGTCACTACAACATGAATGGAATTGCAGAGGTATTGTTGGCCCTGGAAAGGATTGAACATG
ATGAAGAGCTTACATATGAGCAACTGGCTTCTATAGAGACCAATCTATTCTCAAGTGGTATGTTCAGA
TTCTATGATCAGCATAGAGATATGAGGCTTGACATCGATAACATGTCATATGAGGAGTTACTAGCTTT
GGGGGATAAAATGGGTACAGTGAGCACAGCTCTAAGCGAAGAAGCACTCTCAAGAAGCCTTAAGCAAA
GCATTTATCAGGAGACAGATGAAACCGGTTCCATCTCTCTGTATAAGGATGATGATATCAAGTGCAGT
ATTTGCCAGGAAGAGTATGTTGATGGAGATGAATTAGGGACTATTCCATGTCAACATATGTACCATGT
GAGCTGTGTACAACAATGGCTGCGGATGAAGAATTGGTGCCCAATCTGCAAAACCTCTGCGGAAGAAG
AGAAGTCGATTTAG
```

FIGURE 19 (continued)

SEQ ID NO: 273 - protein - Arabidopsis thaliana
MDGCAGKRSVDRLVVPRKASGLTLRENMNKTDGKNVPFCSRVGCTAKVTSTKRSRIGSTDNNTKVGLP
PVPSTLNRKEIVGSSSRTPGGFGYLRKPAKVTARRQPSSSLDTESSETSCIHDDPAATEPTLPRQKTK
RVTINVHPQSAVSREVVITKAGSSSRGTSRISHPKSELGTRDALTGPSVSTSSGNSEHTVRGGLSRHR
LRNLSCNSVSDVLPTNSNSATKISVTKKKNADGESSLSSKGSKTSVLVPKVRNQISSHGNGVTVSDNR
RNRVVPSIRDSSTVVSNGCRRAGYFGRSERLGATASSATSRQMPHPTTPTDPNPSLSFCPSNIYSSTG
RVHSNMPGSPTEADPSSSLVNRDGLSHYNMNGIAEVLLALERIEHDEELTYEQLASIETNLFSSGMFR
FYDQHRDMRLDIDNMSYEELLALGDKMGTVSTALSEEALSRSLKQSIYQETDETGSISLYKDDDIKCS
ICQEEYVDGDELGTIPCQHMYHVSCVQQWLRMKNWCPICKTSAEEEKSI

SEQ ID NO: 274 - DNA - Arabidopsis thaliana
ATGCGACAAAGAAATATGATGACTGGTTCAGACATGGAGCAGAATTCTCAAAGCTTTGTTCCCCATCC
TGAACCTCGCATTGGAACTAACTATCTGTATCCAGATATCCCACCAGTGAACACTGTTCCTCATTTAG
AAGCTCATTCTCTGCAAGAACCTTATGATAACAACTCAATGTTCTACGGGCCTCCACAGTACCATCAT
CAACATGCTTCAAATCTTGGTTCTGGCATGTCAACCGCACCAAATTTCTATGTCCCTTATGTGAATTA
TGAAGCTCCACCGAGTTTTCTGTTGTCTCATGGAAGTAATGATGCAGTTGTTGGAGTTACTTCCACTG
AACATGAGAGAAATGCCCATTTTATGGATCACGGATTCAAAAGAAAGAGTTCTGAAGTAATACCTGGA
AATTCTCAGTATCCAGTTGCTCCTTGTTCTTTCCCTCAATTGAATACATCGGAGACAGCACCTTTTTC
ATTCCCACATTTTGGTACTTATCCACAACCACTAGATCAGAGAAGTGTGAGGAACAGAGCAGGAGCAG
CTACAATGGATCCACTTCTCTCTCATGGTCATAACAACTTCAGTCAAGGAAACTATGCAGCTCATCCT
TTTCCACCTCTTGGCTCAATCTGGTATGACCAACACTGTAATGGCAACAGATCTGATGGATCATCTTC
GCTTTGGTCTCAAGCACCTGCCGTACCTTATATGCATGGTAACATTGCTACTGGATCTATAGAATCTG
GTAATGTTTGCTTCCCAAGATACCATGAAACATCTAGTAGCAGAAACCCCACGCCATCTGTATACCAA
AGGAACCACTATATTAGCCATCACCCCGTACCTCCTCCTCCCATCGTATACCCTCACATGCCTTCAGC
CTCATACGCTGAGACTTTGCATCCTGCTTCATACAGTCATATGGGACAGGTTCAATCAACCGGATTCA
GGATAAACCAATATCCCGGAGAAGATTTTGTACCTGCAGCAATTCTAAGACACCGTGAATTGCCTCAC
TTTAGAGCAATGCCCGCGAATGAAAATGCATTTTGGGAAGTAGGAGACTTCTACAATGCTGTTAATTA
TGTCGATCATCATCAAGACATGCGCTTAGACATAGAAGATATGTCATATGAGGAGCTTCTTGCTTTGA
GCGACCAGATTGGAACTGTGAAGACAGGCTTGTCATCAGAAGATGTTAAAGAACTTCTGAAAAGAAGA
ACCTCGACCAGAATTAACCTGGAAGAAGGTCCATCTACTGATCTAGAGACTGATTCTTGCACGATATG
CCAGGAAAACTACAAGAACGAAGATAAGATCGCAACGCTGGATTGCATGCACAAATACCATGCAGAAT
GCTTGAAGAAGTGGTTGGTTATCAAGAACGTTTGCCCAATCTGTAAATCAGAGGCATTGGTCATAGAG
AAGAAGAAGAAGCTAAGGTTAAGTAGTAGATGA

SEQ ID NO: 275 - protein - Arabidopsis thaliana
MRQRNMMTGSDMEQNSQSFVPHPEPRIGTNYLYPDIPPVNTVPHLEAHSLQEPYDNNSMFYGPPQYHH
QHASNLGSGMSTAPNFYVPYVNYEAPPSFLLSHGSNDAVVGVTSTEHERNAHFMDHGFKRKSSEVIPG
NSQYPVAPCSFPQLNTSETAPFSFPHFGTYPQPLDQRSVRNRAGAATMDPLLSHGHNNFSQGNYAAHP
FPPLGSIWYDQHCNGNRSDGSSSLWSQAPAVPYMHGNIATGSIESGNVCFPRYHETSSSRNPTPSVYQ
RNHYISHHPVPPPPIVYPHMPSASYAETLHPASYSHMGQVQSTGFRINQYPGEDFVPAAILRHRELPH
FRAMPANENAFWEVGDFYNAVNYVDHHQDMRLDIEDMSYEELLALSDQIGTVKTGLSSEDVKELLKRR
TSTRINLEEGPSTDLETDSCTICQENYKNEDKIATLDCMHKYHAECLKKWLVIKNVCPICKSEALVIE
KKKKLRLSSR

FIGURE 19 (continued)

SEQ ID NO: 276 - DNA - Arabidopsis thaliana
ATGCCAGTTTCTGCAGAGCCTTCTTCATCTTCTTCAACAACAATCGGTCAACACATGAGACTCCAACG
ACCTAGGAATCATCGAAATCTCCCACCCATTTCCACCGCCGACGAACCTCTAATCCCCAAACCTAGCC
GCGTCTCTAAATCCGCCATGTCTTCCTTCTTCCTCTTGCCAGAAACTACTAAGAAGAAACCCAACGGA
ACGGCGTCGTTTCGTGGTCTAGGCTGCACAACCTCCGCATCTCAGCAAGTTTCAGTCCCGGCAGTGAT
TCGCTCCTCCGCGGATTGGGATGCTAGTAATTTCAAAATTAAGAAGACGAAGAAGAAGAACAAGAACA
AGGGTAGTAGTAGCTACAATGGTGGTTCGATTAAGATCTTGAGCGAAGCTAGTACTAGTAGTAGCGTC
GCTTGCGCAGCGATTCCTGATGTTTGGTGTGGTCCTGGAGTTGGGTTTTCAACGGATGCTGTCGTCGG
AGGCTCCATTGACACAGTTGTTTCAGATCCTCCGAGAAGGAATATTCCGGTGAGACGCAAAATCGATG
GAGATAAAACCAATAGTAACAGTAATAATCATAGAGAGGGTTCTTCTTCTCTTCTTCCTAGACGATCT
CTCAATCAAGAGTCTAATCCTTATTTTGATTCTGATTCGAGTTTTTTGACATCGCGGGCTGAGCAGAC
TGATAGATATCATCGTCATCTAAGACTGCCTTACCCTGATGGACTCGCTGAGATGATGATGATGCAGA
ATGGTTTTGTGATGGAGGAGTATTAAGCTCATTCGATCAATTCCGTGACATGAGGCTCAATGTCGAT
AACATGACATACGAGCAACTTTTGGAGCTTGGTGAAAGAATTGGGCATGTGAACACTGGACTTACTGA
AAAACAGATCAAAAGTTGTCTTCGGAAAGTCAAACCATGCCGGCAAGATACAACAGTTGCTGATAGAA
AGTGCATCATCTGTCAAGACGAGTATGAGGCGAAGGACGAGGTAGGGGAATTACGATGTGGGCACAGG
TTCCATATCGACTGTGTGAATCAATGGCTTGTGAGGAAGAACTCTTGTCCGGTCTGTAAAACGATGGC
GTACAATAAGTCTTAG

SEQ ID NO: 277 - protein - Arabidopsis thaliana
MPVSAEPSSSSSTTIGQHMRLQRPRNHRNLPPISTADEPLIPKPSRVSKSAMSSFFLLPETTKKKPNG
TASFRGLGCTTSASQQVSVPAVIRSSADWDASNFKIKKTKKKNKNKGSSSYNGGSIKILSEASTSSSV
ACAAIPDVWCGPGVGFSTDAVVGGSIDTVVSDPPRRNIPVRRKIDGDKTNSNSNNHREGSSSLLPRRS
LNQESNPYFDSDSSFLTSRAEQTDRYHRHLRLPYPDGLAEMMMMQNGFVMGGVLSSFDQFRDMRLNVD
NMTYEQLLELGERIGHVNTGLTEKQIKSCLRKVKPCRQDTTVADRKCIICQDEYEAKDEVGELRCGHR
FHIDCVNQWLVRKNSCPVCKTMAYNKS

SEQ ID NO: 278 - DNA - Populus trichocarpa
TGTTGCAGATTTAAGGGAGTTATACCATTCATGGATGACTATTCTGGTAAGAGAGCTGGTGATCGGTT
CATTGTCTCCAGAAAGGGATCTCCCCATGTTTTGAGAGATACTGCTAACAATAGAGATCAAAAAGCTC
AGTTTTGCAACCGAATTGGATGCAGTGGCAGACTGAACTCTAGTAAAGGTACTCAAATAAGTTCAGAA
AAAGCCAAATCTTCAAGGCCAAGGCCATTAATTTCATCTTCCTCGAGTGGCAAGGAAAAAAATGGAAG
CTCGTCTAATAAGGCTTTCTCTGCCATCAGCAAACCTAGAAATTCCTTGCAGGAACCTCGTAAAAAGT
TTTCTTCTCAGCTAGAATCAGAATCCTTAGAAACTGGGAGTGGTCAGGATGAAGTTACACCACCTTCT
GGAAGGATTAAGTTAGACCTTCGCCCTGAAACCGATGGAGCTGCTTCTAGTGATATTACCTCAATGGA
AGCTGGAAGCTCCGGTATATCAAAAGTACAAGATCTCATTGGAATTTTCATCAGAAATCAGGATTGG
TAAACCCCGAGACTGTAGTGGGGTCACCTGTTTCTTTGGCATCCAAAAGCACCATTCAGGGAACTCGA
CTGAATGCCAGCAGGTTTGGTCACAGAAATCTTAGATGCAATACAGTATCTGATTCTTCCTCTTCAGG
TTCTTCATCATCAGATTTAAATCTAAGTAGACGGAAAGACACATTCAACAAGAGAATTTGTGATGGAG
AAAGTAGTTCCTTTGCCAGGGGGAAAAGGATGATTGGGTCTTCATTAGAAGGGCGGAGTTCTAGTTCA
AATTCCGGTATCTCCATTTCTGATTCAAGGCGAGCTAGAACTGGAACTTTGAATAGGGATAGCAGTGC
TGCATCAATTGGGTCTCGAAGACCACTCAGTGGCTACACGAGGGCAAGGGTCGCTAACCAAGGAAGTG
GAAACAATTTATCAGCAAATGAGATCCCACTAACATCTCAACCTGATATGTCCCTGGATTTGAATGCT
CCGAGTTCATCACACCACTTCTCAGTGGAAGCCTCTTTAGGCCGCCCAAGTTCTTATAGTCGACCTGG

FIGURE 19 (continued)

```
CAGTAGCAATGGGAGTTTACGGGGTATTAGGCCATCCAGTCCAGAAGTTAGCAATGCCCAATCTTTGA
TGAATCGTGAGAGCTTCCAGCGCTACAATATGGTTGGGATTGCTGAGGTATTATTGGCACTCCAGAGG
ATTGAACAAGATGAAGAACTAACATACGAGCAATTGCTTGTTTTGGAGACCAGTTTGGTCCTTAATGG
ACTAAACTTCCATGATCAACATAGAGACATGAGACTGGATATCGACAATATGTCATATGAGGAACTAT
TAGCTCTTGAAGAGAGAATGGGTACTGTGAGCACAGCACTAACAGAGGAAGCCTTGTCAGAATGCCTC
AAGACTAGCATTTATCATTCCACTCCTATGGAGGATGCGACTGCAAACCTTGAAGGTGATAAGGATGA
CATCAAGTGCAGCATCTGTCAGGAAGAGTATGTTGTTGGAGATGAAGTGGGAAGGTTACAATGTGAGC
ATGGATATCACATGTCCTGCATACATCAATGGCTAAGTCTGAAAAATTGGTGCCCTATTTGCAAGGCA
TCAGTGGCTCCGTCGCCACCATCCTCGTAAACAATTAATAAACTGGATGCAGGCGACTGGCTTTTTCA
TTTTGTACAAAATAAGTCTGTCACCTTCATCTTTTTTCTTT
```

SEQ ID NO: 279 - protein - Populus trichocarpa
```
MDDYSGKRAGDRFIVSRKGSPHVLRDTANNRDQKAQFCNRIGCSGRLNSSKGTQISSEKAKSSRPRPL
ISSSSSGKEKNGSSSNKAFSAISKPRNSLQEPRKKFSSQLESESLETGSGQDEVTPPSGRIKLDLRPE
TDGAASSDITSMEAGSSGISKSTRSHWNFHQKSGLVNPETVVGSPVSLASKSTIQGTRLNASRFGHRN
LRCNTVSDSSSSGSSSSDLNLSRRKDTFNKRICDGESSSFARGKRMIGSSLEGRSSSSNSGISISDSR
RARTGTLNRDSSAASIGSRRPLSGYTRARVANQGSGNNLSANEIPLTSQPDMSLDLNAPSSSHHFSVE
ASLGRPSSYSRPGSSNGSLRGIRPSSPEVSNAQSLMNRESFQRYNMVGIAEVLLALQRIEQDEELTYE
QLLVLETSLVLNGLNFHDQHRDMRLDIDNMSYEELLALEERMGTVSTALTEEALSECLKTSIYHSTPM
EDATANLEGDKDDIKCSICQEEYVVGDEVGRLQCEHGYHMSCIHQWLSLKNWCPICKASVAPSPPSS
```

SEQ ID NO: 280 - DNA - Populus trichocarpa
```
TAACTTCCGCTTCTGCTTGTGCAGGATGTTATGATTCTTGACCAATCAGTTTTGTTTGGAGCAGCTGA
CATGTATGATAGGCATAGGGATATGCGGCTTGATGTTGATAACATGTCTTATGAGGAGTTGCTGGCTT
TGGAAGAGCGCATTGGAAATGTCAGTACTGGATTGAGCGAAGAAACTATAGTAAACAACTTAAAACAG
CAGAAATACTCTGTTGCTGTTGGAGCGAAGGTGGAGGCTGAACCATGCTGCATTTGCCAGGAGGAATA
CAATGATGGAGAAGATCTTGGAACACTGGACTGCGGACATGATTTCCACGCGGGGTGTGTTAAGCAGT
GGCTGATGCACAAGAATTGGTGCCCCATCTGCAAAACAACAGGACTTGCTACATGAGAAAGGGTAAAG
ATGTTCAGGCCATTACACACGGTTGGTACACGGTTGTACGAGGAAAACGTGAGAGGCGTGGCCCTAGA
```

SEQ ID NO: 281 - protein - Populus trichocarpa
```
MILDQSVLFGAADMYDRHRDMRLDVDNMSYEELLALEERIGNVSTGLSEETIVNNLKQQKYSVAVGAK
VEAEPCCICQEEYNDGEDLGTLDCGHDFHAGCVKQWLMHKNWCPICKTTGLAT
```

SEQ ID NO: 282 - DNA - Populus trichocarpa
```
GTTATGAGTCAGCAAACACCTTTCAGTAACATGCTAAATCCAGTGGATAGCAGATTGTCAAATAATGC
TGTATCTTCGGGCAACGCATCGTGCTCAAATGCTTTAACTCACGATGTCCAGAGCTTTAGTGGTTGGA
ATTCAGGCGAATCTAGCTCAAGGTTAAGTCTGCAAAATCAGGTGAATGATGATGGGATAAAAATGGAA
GAATGGTTGTCTACTTCAGTCAATGCTTATCCTGCAGTTGGTCAAAGATCAGAGGAAAGGCTATTTGA
AACAACTAATATCCTTTTCCCAGGCAGAGTCAGTACGGGGATTAGTGGCAATCAGGTTAGAAGTGGAC
CTTTATTCTTGCAGGGCTCCAGCTCGAATCATATCGCACCCAATGTATGTCCAAATTCTGGTCATATT
GGAGACACCACTATTGGCAGACCCATTACAGGAGCTGTCTTAGGCCTTAATCAACTCAACCCTGGTGG
TGGATTAGAAATAGAACGGGCATCTTCTTCTGGTGTTTCTTCTTCTGATGTTGGCACTTCATCTGGAA
```

```
GTTCTGGTTATATAGTAGAGGAGACAAATGGTGGTTCAGGATCTTCTATTGGGGTTTGGGGCTTATCC
TGCAAGAGAAAGGCCCTTGAAGGTACTACTGGACAGTCTTTTCCTGGTGGAAGTTCAAGTTGCTTTCC
ACAAGCTGAAAGTAGTGCATGGCATAATGGACCCAATAATCACAGTGTTTCTAGCAGCCTAAGTTTAT
CCACTCCCTCACCGAATACTCCAAGTGTTGCTCCTCCTGAACAGTTGAACCCAAGATTTGGTTATGGA
ATGAGAGGAGCACCTCCTGATGCATTTCCTTCATCAAATGTTAGTGGAAATGCAGACTCTCTGAGAAA
TTTTGGTAGGAGGATAAGTCCTGGACATCAACAGGAATCTGTCACTTTCAATTTGTCAACAACAGGAG
GTTCCAGGCGTTGGTCCTTGCAGCATTCTCGCAGACCTGTCTCAGTTAGTGACTATCTGGAGTCAAGA
TCAACAGAACCTGCAAATTCAAGTGCCATCCAAGGCCAGCTTCATGCTATCAACCCTTCTTCTTTATC
AAGCAGTTTGCCTTGTTGGGATGATTTTTCAAGTTCAAGAGTTGGAAATTCATTGAGTTCCCTTATAC
CTGGAGAGCTAGGTGCTGCATCAAGAGAGGAAGCAAACTTAAGAAGCTTTCAGACAAATAATGCAGAC
CATCCAATGTTTGCACCTGCAACTGAAATGAGAAGAATGGGACAAGATCCAACACGCTGGGGTTTGGC
CACTGGGAACATGAGTGCCTCGGGTAGTGTTTCTTCTACCAGAATTGGTTCTTCTACCAGAATGGGCC
CCAGTTCAAGTGTCCATCCTTTTCCTACTCCCGGATGGATTCATCACAACCCCACAACACATAATCAG
CAAAGAATTTCTGAATTTTCTACTTGGTCTCTGTTCCCACCTATGGCCTCTGAATCTGGAGGTCACAG
TTGCCATTTCTCCCCTTTGTCTTCTGGTCCTTCCTCTGCACAGGACACACAGATTTCTTCTGGATCTA
GTAGCCAGGGACATAATCCACCACCATTTCCAAGGTCAGCATTTCTCACGGAAGAACAAAGTGATGAT
GTTCTTGGAATGCCCCGTTCCTTGAGGGCTTTAGCTGCTGATATTGAAGGGAGACATCGGCTCATATC
TGAGATTCGTCAAGTATTGAATGCCATGCGCAGGGGTGAAAATCTTCGTGTTGAGGACTACATGCTTT
TTGACCCGATGATCTATCATGGGATGGCTGAAATGCATGATCGGCATAGAGATATGCGCCTTGATGTT
GATAATATGTCTTATGAGGAATTGTTGGCATTGGAAGAACGCATAGGAGATGTGAGCACTGGACTAAG
TGAGGAAACCATTTTGAAGTTACTGAAACAGGAAAAACATGTGCCGATCAGCACAGAATCTCCAGCAG
ATTTGGAGCCTTGCTGTATCTGTCAGGAGGAATATGTGGATGGGGATGATATGGGAATAATCGACTGT
GGGCATGACTTTCATACCAACTGCATCAAACAGTGGCTAATGCAGAAAAATCTATGTCCAATTTGTAA
GATGACGGCCCTGCTCACTTGAGAGGGAAGATAATGCCAGTTCCTGGAAATTTTATTTTCTTAAAAAC
AAATCAACATCCAAATACTGGGTGGATGATATCC
```

SEQ ID NO: 283 – protein – Populus trichocarpa
```
MSQQTPFSNMLNPVDSRLSNNAVSSGNASCSNALTHDVQSFSGWNSGESSSRLSLQNQVNDDGIKMEE
WLSTSVNAYPAVGQRSEERLFETTNILFPGRVSTGISGNQVRSGPLFLQGSSSNHIAPNVCPNSGHIG
DTTIGRPITGAVLGLNQLNPGGGLEIERASSSGVSSSDVGTSSGSSGYIVEETNGGSGSSIGVWGLSC
KRKALEGTTGQSFPGGSSSCFPQAESSAWHNGPNNHSVSSSLSLSTPSPNTPSVAPPEQLNPRFGYGM
RGAPPDAFPSSNVSGNADSLRNFGRRISPGHQQESVTFNLSTTGGSRRWSLQHSRRPVSVSDYLESRS
TEPANSSAIQGQLHAINPSSLSSSLPCWDDFSSSRVGNSLSSLIPGELGAASREEANLRSFQTNNADH
PMFAPATEMRRMGQDPTRWGLATGNMSASGSVSSTRIGSSTRMGPSSSVHPFPTPGWIHHNPTTHNQQ
RISEFSTWSLFPPMASESGGHSCHFSPLSSGPSSAQDTQISSGSSSQGHNPPPFPRSAFLTEEQSDDV
LGMPRSLRALAADIEGRHRLISEIRQVLNAMRRGENLRVEDYMLFDPMIYHGMAEMHDRHRDMRLDVD
NMSYEELLALEERIGDVSTGLSEETILKLLKQEKHVPISTESPADLEPCCICQEEYVDGDDMGIIDCG
HDFHTNCIKQWLMQKNLCPICKMTALLT
```

SEQ ID NO: 284 – DNA – Populus trichocarpa
```
CTCTCCCTCTCATTGACAAAGCACAAAGATATGCCGGTTTTTGCAGAGAGCAGCAACACAACTATAGC
TGACCAAATCAAGCTAAGAAAACACAGAGAGCTGCAACCCATTGCAACTGAAACAGATCCAAACCCAC
ATATCTCTAGGACCTCCAAATCCAATACAATAATCTCCTCCCTCTTCCACTCTCACTTCACTGCAACC
CCACCTGACCAAACAAAGAAGAAAGGTGCAACCTTTAGAGGCCTAGGATGCACTGCTGGAGCAGCACA
```

FIGURE 19 (continued)

```
GCAGGTGTCGGTGCCGGCGGTGATAAGGTCATCGGCTGGCTGGGAAGGGAAAAGGGTCAAGAAGAAAA
AGGGTCATCAGAAAAGAAAGAAAGAAAGCTTGAAACTTTCCAGTGACAACAACAACAATAGTAATAAT
AGCAATGGTGATGGTGATCTTAGTGGAGATGGTAATCTTGGGAATTGCATGGTTATGCAAGATGTTTG
GTGTGGACCTGGAATTGGGTTTTCAGGTGCTGATGCTGTTGTTGGTCAGTTGACTGTGTTGTCGTTA
GAAGGAACGCGTCATCCGGAAGAGGGAAGATTGATGAAGGAGAGAAATTTAATCAAAGGGAAAGAGAG
AGGGGGAGAGAGAGAGAGCGTCCTTGTTTATCTAGGCGGGCTGCAGTGAATCCTGAAACCCCCTCGTT
TCTGGATACTGATCCTGCTTTTGTAACATCTCGTCCTGAAATAGAAGTTTTTGGAACTCGGTATTATC
GCCATATCCGACATCCTTCCCCAGATGGACTTGCTAGGATGATGATGCTCCAGAATAGTTTTATCATG
GGAGGAAGATTGGATCGATTTAGCAACTGGAGACTTGATATTGATCACATGACATATGAGCAACTGCT
CGATTTAGGTGATAGAATTGGTTATGTGAATACTGGATTGAAAGAAGATGAGATCAGCAGCTGTGTCA
AGAAAATTAATCCCTCAATCATCGAAGAACTGCCATCACATTTACACATGACATTGGAAAAGAAGTGC
AGCATTTGTCAGGATGAGTTCGAAGAAGCTGATGAGTTAGGCAAACTAGATTGTGGACATGGTTTTCA
CATACAATGTATAAAGAAATGGCTTGCACAGAAAAATACATGCCCGGTCTGTAAAACTGAACCGGTGG
CTCGAGCCTAATATCTTCAAACTGCTGCTATTTACCTGTTGGTGTGTATAGATTTCATTTCCTATACG
TATTCAAGCATCCATTCTTTAGC
```

SEQ ID NO: 285 - protein - Populus trichocarpa
```
MSQQTPFSNMLNPVDSRLSNNAVSSGNASCSNALTHDVQSFSGWNSGESSSRLSLQNQVNDDGIKMEE
WLSTSVNAYPAVGQRSEERLFETTNILFPGRVSTGISGNQVRSGPLFLQGSSSNHIAPNVCPNSGHIG
DTTIGRPITGAVLGLNQLNPGGGLEIERASSSGVSSSDVGTSSGSSGYIVEETNGGSGSSIGVWGLSC
KRKALEGTTGQSFPGGSSSCFPQAESSAWHNGPNNHSVSSSLSLSTPSPNTPSVAPPEQLNPRFGYGM
RGAPPDAFPSSNVSGNADSLRNFGRRISPGHQQESVTFNLSTTGGSRRWSLQHSRRPVSVSDYLESRS
TEPANSSAIQGQLHAINPSSLSSSLPCWDDFSSSRVGNSLSSLIPGELGAASREEANLRSFQTNNADH
PMFAPATEMRRMGQDPTRWGLATGNMSASGSVSSTRIGSSTRMGPSSSVHPFPTPGWIHHNPTTHNQQ
RISEFSTWSLFPPMASESGGHSCHFSPLSSGPSSAQDTQISSGSSSQGHNPPPFPRSAFLTEEQSDDV
LGMPRSLRALAADIEGRHRLISEIRQVLNAMRRGENLRVEDYMLFDPMIYHGMAEMHDRHRDMRLDVD
NMSYEELLALEERIGDVSTGLSEETILKLLKQEKHVPISTESPADLEPCCICQEEYVDGDDMGIIDCG
HDFHTNCIKQWLMQKNLCPICKMTALLT
```

SEQ ID NO: 286 - DNA - Populus trichocarpa
```
CATTATATTAGGGGGAACACATTGTGCCTGATGCATAGGCAAAGGGGTGCATTTCATACCTTTTCTGA
AACTATTGACATTGATCAGGGATCTGTTTCAGACAATATCGGTACAAGTCAGCAAACTTCTTTTGGTA
ACATGCTAAATCCAGTAGATAGCAGATTGTCAAATAATGCTGTATCTTCTGGCGATGTATCATGTTCA
AATGCTATGACTCATGATATTCAGAACTTCAGTGGCTGGAATTCAGGTGAATCTAGCTCAAGTTTAAG
TTTGCAAAATCAGCTGAATGATGATGAGATAAAAACGGAAGAAAGGTGGTCTTCTTCAGTCAATGCTT
ACCCTGCAGTTGGTCAAAGATCAGATGAAAGGCTATTTGAAACAACTGATATCCTTTTTCCAGGTAGA
GGCAATATGGGGATCAGTGGCAATCAGGTTAGGAGTGGACCTCTATTCTTGCAGGGCTCCAGCTCTAA
TCATATCCCACCAAATGAAAGTCCAAATGCTGGTCATATTGGAGACACCATTAATGGCAGGCCTATTA
CAGGAGCTGTCTTAGGCCTTAATCGTCTCAACCCTGGTGGATTAGAAATAGAGTTGGCATCATCTTCT
GGTGTTTCTTCTGATGATGTTGGCACTTCATCTGGAAGTTCTGGTTGTATAGTAGAGGAGACAAATGG
CGGTCCAGGATCTTCTCTGGGGGGTTGGGCTTATCCTGCAAGAGAAAGCCCTTGAAGGTACTTCTG
GACAGTCTTTTCCTGGTGCAAGCTCAAGTTGCTTTCCACAAGCTGAAAACAGTGCATGGCATAATGGC
CCCAATAATCATAGTGTTTCTAGCAGCTTAAGTTTATCCACTCCCACTTGGAATGCTCCTAGTGTTAC
TCCTCCTGAACAGTTGAACCCAAGATTTGGTTATGGAATGAGAGCAGCACCTTCTGATGCGTTTCCTT
```

FIGURE 19 (continued)

```
CATCAAATGTTAGTGGAAATGCGGACACTCTGAGAAATTTTGATAGGAGGACAAGTCCAGGACTTCAA
CAGGAATCTGCCGCTTTCAATGTATCAACAACAGGAGGTTCCAGGCGATGGTCCTTGCAGCACCCTCC
CAGACCTGTCTCAGTTAGTGACTATCTGGAGTCAAGATCACCAGAACCTGCAAATTCAAATGCTACTC
AGGGCCAACTTCATGCCATAAACCCATCTGCTTTATCTAGAAGCATGCTTCGGTGGAATGATTTTTCA
AGTTCGAGAGTTGGAAATTCACCAAGTTCCCTCATCCCTGGAGAGCTAGGTGCTGCATTAAGAGAAGA
AACAAACTCAAGAAGATTTCAGAGAAATAATGCAGAGCATCCAATGTTTGCACCTGCAACTGAAATGA
GAAGCATGATACAAGATCCAACATGCTGGGGTTTGGCCACTGGGAACATGAGCACCTCAGGTAGTGTT
TCTTCTACCAGAATTGGCCCCAGTTCAAGTGTCCGTCCGTTTCCCACTCCTCGATGGATTCATCGCAA
TCCTACAACACATAATCAGCAAAGATTCTCAGAATTTTCTACTTGGTCTCTTTTCCCACCAATGGACT
CAGAACCTGGAGGTCATAGTGGTCATTTCTCCCCATTGTCTTCTGGTCCTTCTTCTTCTGCACAGGAC
ACAGTGATTTCTTCCGGATCTAATAGCCAGGGACATAATCCACCATTTCCAAGGTCAGCACTTCTCAT
GGAAGAACAAAGTGATGACATTCTTGGTATGCCCCGTTCATTGAGGGTTTTAGCTGCTGATATTGAAG
GGAGACATCGGCTAATATCTGAGATTCGTCAAGTGTTGAATGCCATGCGCAGGGGTGAAAACCTTCGA
GTTGAGGATTATATGCTTTTTGACCCGTTGATCTATCATGGGATGGCTGAAATGCATGATCAGCATAG
GGATATGCGCCTCGATGTTGATAACATGTCCTATGAGGAATTGTTGGCATTGGAAGAACGCATAGGAG
ACGTGAGCACTGGACTAAGTGGGGAAACCATTTTGAAGTTAATGAAGAAGCAAAAGCATGTGCCTGTT
AGCACAGAATCTCCAGCAGATTTGGAGCCTTGCTGTATCTGTCAGGAAGAATATGTGGATGGGGATGA
TATGGGAATAATCGATTGTGGACATGACTTTCATGCCAACTGCATCAAACAGTGGCTAATGCAGAAAA
ACCTTTGTCCCATTTGTAAGATGACAGCCCTAATCACTTGAGAGGGAAGATATTGTCAGGTCCTGGGA
ATTTTATTTTCTTAAAAACGGACAATCATATCCAAAACCTGGGTAGATGGTAT
```

SEQ ID NO: 287 - protein - Populus trichocarpa
```
MHRQRGAFHTFSETIDIDQGSVSDNIGTSQQTSFGNMLNPVDSRLSNNAVSSGDVSCSNAMTHDIQNF
SGWNSGESSSSLSLQNQLNDDEIKTEERWSSSVNAYPAVGQRSDERLFETTDILFPGRGNMGISGNQV
RSGPLFLQGSSSNHIPPNESPNAGHIGDTINGRPITGAVLGLNRLNPGGLEIELASSSGVSSDDVGTS
SGSSGCIVEETNGGPGSSLGGWGLSCKRKALEGTSGQSFPGASSSCFPQAENSAWHNGPNNHSVSSSL
SLSTPTWNAPSVTPPEQLNPRFGYGMRAAPSDAFPSSNVSGNADTLRNFDRRTSPGLQQESAAFNVST
TGGSRRWSLQHPPRPVSVSDYLESRSPEPANSNATQGQLHAINPSALSRSMLRWNDFSSSRVGNSPSS
LIPGELGAALREETNSRRFQRNNAEHPMFAPATEMRSMIQDPTCWGLATGNMSTSGSVSSTRIGPSSS
VRPFPTPRWIHRNPTTHNQQRFSEFSTWSLFPPMDSEPGGHSGHFSPLSSGPSSSAQDTVISSGSNSQ
GHNPPFPRSALLMEEQSDDILGMPRSLRVLAADIEGRHRLISEIRQVLNAMRRGENLRVEDYMLFDPL
IYHGMAEMHDQHRDMRLDVDNMSYEELLALEERIGDVSTGLSGETILKLMKKQKHVPVSTESPADLEP
CCICQEEYVDGDDMGIIDCGHDFHANCIKQWLMQKNLCPICKMTALIT
```

SEQ ID NO: 288 - DNA - Populus trichocarpa
```
CCTCTCTCTGATAAACAAAGCACAAAGATCATGCCAGTTTTTGCAGAGAGCAGTAGCAGCACACCAGC
AGCTATAGCAGACCAAATCAAGCTAAGAAAACCCAGAAGCCAACAAGAGCTGCAACCCATTTCAACTG
AAACAGATCCAAACCCACATGCTTCCAAGTCATCCAAATCCAACACAATTATCTCCTCCCTCTTCCAC
TCTCACTTCTCTACAACCCCACCTGACCAATCCAAGAAGAAAGGTGCCACCTTTAGAGGCCTAGGATG
CACTGCTGGAGCAGCTCAGCAAGTATCGGTGCCGGCGGTGATAAGGTCATCCGCGGACTGGGAAGGGA
AAAAGGTCAAGAAGAAAAGGGCCATCCAAAAGAAAGAAAGAGAGCTTGAAACTTTGCAGTGACAAC
AACAATACTAGTAATAGCAATGGTGATGTTAATGGAGATGGTAATTTTGCGAATTGTATGGTTATGCA
AGATGTTTGGTGCGGACCTGGAATGGGGTTATCTGGTGCTGATGCTGTTGTTGGGTCAGTTGACTGTG
TTGTGGCTAGAAGAAACGTGTCAATTGGTAGAGGAAAGATTGACGGAGGAGAGAAAATTAATCAAAGG
```

FIGURE 19 (continued)

GAAAGAGAGAGGGAGAGGGAGAGGGAGAGGGATAGAGAGAGGGAGAGGGAGCGTCCTTGTATAGTTAG
GCGGGCAGCAGTTAATCCTGAAACTCTTTCATTTCTGGATACTGATCCTGCCTTTATAACATCTCGTC
CTGAGCCAGAAGTTTTTGGAACTCGGTATTATCGCCATATTCGACATCCTTCCCCAGATGGACTTGCT
GAGATAATGATGCTCCAAAATAGTTTCATCATGGGAGGAAGAATGGATCGATTTAGCAACTGGAGACT
AGATATTGATCACATGACATACGAGCAACTGCTCGATTTAGGTGATAGAATTGGTTATGTGAATACTG
GATTGAAAGAAGATGAGATCAGCCGCTGTGTTAAGAAAATTAATCCCTCATTCATCAAGGAACTGTCA
TCACATTTACCCATGGTATTGGAAAAGAAGTGCAGCATTTGTCAGGATGACTACGAAGAAGATGGTGA
GGTGGGAAAACTTGATTGTGGACATGGCTTTCACATACAATGCATAAAGCAATGGCTTGGACAGAAAA
ATACCTGCCCAGTATGTAAGACAGAACCGGTGGGTCGAGGCTAGTATCTTCAAACTGCTGCCATTTAC
CCGTTGGTGTGTATAGATTTCATTTCCTACGTAATCAAGCATTCATTCTTTGGC

SEQ ID NO: 289 - protein - Populus trichocarpa
MPVFAESSSSTPAAIADQIKLRKPRSQQELQPISTETDPNPHASKSSKSNTIISSLFHSHFSTTPPDQ
SKKKGATFRGLGCTAGAAQQVSVPAVIRSSADWEGKKVKKKKGHPKRKKESLKLCSDNNNTSNSNGDV
NGDGNFANCMVMQDVWCGPGMGLSGADAVVGSVDCVVARRNVSIGRGKIDGGEKINQRERERERERER
DRERERERPCIVRRAAVNPETLSFLDTDPAFITSRPEPEVFGTRYYRHIRHPSPDGLAEIMMLQNSFI
MGGRMDRFSNWRLDIDHMTYEQLLDLGDRIGYVNTGLKEDEISRCVKKINPSFIKELSSHLPMVLEKK
CSICQDDYEEDGEVGKLDCGHGFHIQCIKQWLGQKNTCPVCKTEPVGRG

SEQ ID NO: 290 - DNA - Populus trichocarpa
AGCTTAAATTATCTTCTGCTGTAAGGGGTCATGGGACATAGACAAATGTTCAACCCTTCTCAATTCTT
CGAGATGGAGCAGGATTGGAGCCATGGCCACCCAGCTGCTGGACAGTCCTATGTTCATATGGGAAGGG
CTGTTTCTCAAGAAAATGGTTCCTTTTCTCATCCTATCAATCCTCCTTCAATAGATGGACCCAGCTGT
GCCTCTCGGCGGAACCTGGAAAACAGAGCTCTTGAGCATTCCTCTACATATTTCAGGTCAGAAGGTCC
GCAAGTTCACGCTCCCCTTTCTGCCCCCCGACATGATGTATTCCCACACTGTCCAGCTGGTGGAAGCT
TTTACCCTCCTCCAGAGCTCGAAGCTACCCATGTTCATTCTAATCACCACAACAGGCATGGTATCCAT
GAAGGTGAGGGTGGTCTCCTTGATCATACAATGAGTGCTGGAAGAGGGCCATTCAAAAGAAAAGCCC
TGGTGTTCCTACCTCGTGGGAAGAGGTGGCACCAGCAGTATGTACAGTGCAGGAAGTTCCTCCAATT
CTTTTGAACTTCACCATGAGAAACCAACTTCAGATTATAGAAATTACTTTTCAGAATCCTCTGGTTTA
CCTCCCTATATGGGTAGCAGCCTGTCAATTGGGGGTGAAGATCCTCCAAGGAATGTGAGAAGCAGATC
TAGACTTGATTTGGAGCCCAACCCAAGGAGAACCCATTCATCAAGTTACACGTCCCATCCTTTTTCTT
CAACATCTCATCTCCGAAACCATCCAGGGCCAGTGGATGTTGCTAACTTAAATGCTGACAGAACTGCT
TATGAGCAGAACCAAATTGGTGTTCCACCTCCTGCACATGGGAGGTTTCATACTTCAGAAAATAATTC
CTTGAGCCATGAGATGAATCAGCATTATGCTGGAGGGAATCCTACTGATATTCGTCGGTACAACCATG
ATTCCATCTTAAGCAGAAATCCCATTGCACCACCACGACATCTTCATGGTTTTCATGCCCAGGCTTCA
AGGGAGGGTCAGAACAGTTATTCTCGAAGAGCTATACCTACACGTCGGGCTGATATAAACTCCTCTCA
TCTCAGACAAGAAGCTGCTGCTGTCGAAATGGTCAGCATTTTCTATCAGAAACCCATAGTTCCAGAT
ATTCAAGACCACTTTTGTCTGGAGGTTGGCACAGCAATCATAGAGAAGGAAGGTCAAGGATATCAATT
GAGAGATTCCAGTCTCTTTCAAATGTGGTGGATGTGCGTGATAGAATGGGATCTGAGGCTCTTATGAT
GTTAGATCACTCATATTTATATGGCTCCAGAAATTTCCTTGATCAATACAGGGACATGAGACTGGATG
TTGACAGCATGAGTTATGAGGAACTACTTGCTCTAGGAGAAAGGATAGGGATTGTCAACACAGGATTG
CCTGAAGATGTGTTTTCAAAGTGCTTGGTGGAGACAAGATGCCATTCTTCAGACAAAGCCCAGGAAGA
AACATCCTGTGCCATATGCCTTGAAGAGTACAAGAGCATGGATAAAGTTGGAATGATAAGGAACTGTG
GACATGTTTATCACGTCGACTGCATCAAGAAGTGGTTGTCAATGAAGAATATGTGCCCCATCTGCAAA
GCACCTGCTGTTGCTGATGGTTCGAACAAGGAATGATTTGCTTTTACTTCCTCTATTTGATCTTGTTC
ACTTTATCTTGTATATAATAATTTGGTGATGGGATTTGATGACCATTT

SEQ ID NO: 291 - protein - Populus trichocarpa
MGHRQMFNPSQFFEMEQDWSHGHPAAGQSYVHMGRAVSQENGSFSHPINPPSIDGPSCASRRNLENRA
LEHSSTYFRSEGPQVHAPLSAPRHDVFPHCPAGGSFYPPPELEATHVHSNHHNRHGIHEGEGGLLDHT
MSAGRGPFKRKSPGVPTSWERGGTSSMYSAGSSSNSFELHHEKPTSDYRNYFSESSGLPPYMGSSLSI
GGEDPPRNVRSRSRLDLEPNPRRTHSSSYTSHPFSSTSHLRNHPGPVDVANLNADRTAYEQNQIGVPP
PAHGRFHTSENNSLSHEMNQHYAGGNPTDIRRYNHDSILSRNPIAPPRHLHGFHAQASREGQNSYSRR
AIPTRRADINSSHLRQEAAAVENGQHFLSETHSSRYSRPLLSGGWHSNHREGRSRISIERFQSLSNVV
DVRDRMGSEALMMLDHSYLYGSRNFLDQYRDMRLDVDSMSYEELLALGERIGIVNTGLPEDVFSKCLV
ETRCHSSDKAQEETSCAICLEEYKSMDKVGMIRNCGHVYHVDCIKKWLSMKNMCPICKAPAVADGSNK
E

SEQ ID NO: 292 - DNA - Populus trichocarpa
CTTGGCTATGAAGCAGGGATAATTTGAGATATGGGACAAAGAAACATGCTATGCACCAATCAGATGAT
TGATTTAGAAATGGATCAACAAAGCCAGGGATATCTACATCCTGAGCCTTGCATCCTTTTAGGGGGTG
TGACAAACTTCCGACCATCTGATATTCCAACCATGGTAGCAGCTTCAGGGAACACTAACAATCGTGAC
GCTCATCTAGTGGATCATTATGATGGTGCTATGTTTTATGGTATGCCCCAATACCATGGTCTTCATCC
CCATCGTCAATATCATGGCCCAAATCTTGATTTAAGTGTTGCTACTGCACCCAACTTCTATGTTCCTT
ACATGACTCCATCTTCTGGTATTCCTATCAGTCATGGGCCTTGTGATCAGTTATCATCTTCCAACAAT
TATGGAGTGATTGAAGTTTCTGCTGATGAGTATGGAACAAACAGTCACTTCATGGATAATGCTAGAGG
TTCATTCAAAAGAAAGAATGCTGAAGGAAACCCAGGGAATTTCCAGTATCTGAATGCATCGGCAAGCT
CTAGTTCTTCAGTTGCCCCATTGAATACTAGGCATTCTGAGGGGGGTGCTCTGATGGATGCTACATCA
TTCACCCCGCCACATTACCGAGGGAGCAGTGCTTCATCAATCAGAGATGTGGGATCTCAAAGCAGTGT
GAGGAATAGATTAGGTGCTGCTGGGTTAGATCCTGCTCTGGCGCACAATCTAAACCATTTTATTCAAG
GAAACTATTTGGGTCAACCCTATCAGCCAAGTGGCTCTCTTTGGCTAGATCAACATTTAAGCAACAGT
GGTACTGATGCAGGCACTTCAGGATGGACTCAGACCACTGCTATTCCTTACATGCATGGGAACAATCT
CAATGGAGGTCCTATAGAAATTGGAAATATGGGTCTACAGCGGTATCATGAGCCAGCTAGCAACAGAA
GTAATGCCAGTTTCTCCCGCCCTTCTGCAGTGAACCTTCAGCATCACAATTTTCATCATATGTCTCCA
CCAATTCAAGGAATGAGAGGCCACAATATTAATATTCTTCCTCAAGCACCAGCAGCTTCATTCAGAGT
TCCTACAGCCAATGCCTCACAAATCACCATGAATCCATCTCAAGATGGTTTAGATATTGGACTTAGGC
ATCTAGGATCAGTTCAACCAACTGGCCTTAGAATGTACAGGTCTCACCGTGAGGGAGTTGTACCTGAG
ACCACCCTAAGACATCGCAACCTCCCTCAGTTGAGAGTATTGCCAACAGATGGGGTAGCAATATTAGG
GTTCCCTGACTATTATGAAGTAGAGAATCATGTTGACCACCACAGAGATATGCGCTTGGATATAGAGG
ACATGTCTTATGAGGAGCTTCTTGCACTAGGGGAGCGAATTGGCAATGTAAATACTGGATTGTCAGAG
GGAACCATCAGAAGCCAATTAAAAACAAGGACTTATTTATCATCTCCTTCAATCAATTTGGAAGAGGC
AGCTTGTATGGATCAAGAAGCTGATTCTTGTATTATTTGCCAGGATGATTATAAGAGCAAGGAGAAAA
TTGCAGCTCTTGATTGTGGACATGAGTATCATGCAGTTTGCTTGAAGAAGTGGCTACGCTTGAAGAAT
GTCTGCCCCATCTGCAAATCAGAAGCCTTAAACACGGAAAGAATGGATGTTTAAGGTGGTGATCTTGC
TTTATATAAAATGAAAGGAAAAATAAAGTAGAGGAAAGGGGTGACAGTTTCTTTCTCATAATTTGT

SEQ ID NO: 293 - protein - Populus trichocarpa
MGQRNMLCTNQMIDLEMDQQSQGYLHPEPCILLGGVTNFRPSDIPTMVAASGNTNNRDAHLVDHYDGA
MFYGMPQYHGLHPHRQYHGPNLDLSVATAPNFYVPYMTPSSGIPISHGPCDQLSSSNNYGVIEVSADE
YGTNSHFMDNARGSFKRKNAEGNPGNFQYLNASASSSSVAPLNTRHSEGGALMDATSFTPPHYRGSS

FIGURE 19 (continued)

ASSIRDVGSQSSVRNRLGAAGLDPALAHNLNHFIQGNYLGQPYQPSGSLWLDQHLSNSGTDAGTSGWT
QTTAIPYMHGNNLNGGPIEIGNMGLQRYHEPASNRSNASFSRPSAVNLQHHNFHHMSPPIQGMRGHNI
NILPQAPAASFRVPTANASQITMNPSQDGLDIGLRHLGSVQPTGLRMYRSHREGVVPETTLRHRNLPQ
LRVLPTDGVAILGFPDYYEVENHVDHHRDMRLDIEDMSYEELLALGERIGNVNTGLSEGTIRSQLKTR
TYLSSPSINLEEAACMDQEADSCIICQDDYKSKEKIAALDCGHEYHAVCLKKWLRLKNVCPICKSEAL
NTERMDV

SEQ ID NO: 294 - DNA - Populus trichocarpa
CTTGGCTATGAAGCAGGTATAATTTGAGATATGGGACAAAGAAACATGCTATGCACCAATCAGATGAT
TGATTTAGAAATGGATCAACAAAGCCAGGGATATCTACATCCTGAGTCCTGCATTCTTCTAGGGGGTG
TGACAAACTTCCGACCACCTGATATTCCTACCATGTTAACAGCTTCAGGGAACACTATCAATCGTGAC
GCCCATCTAGCTGATCGTTATGATGGTGCTATGTTTTATGGGATGCCCCAATACCATGGTGTTCATCC
TCATCCTCAGTATCACAGCCCAAATCTTGATTTAAGTGTGGCTACTGCACCCAACTTCTATGTTCCTT
ACATGACTCCATCTTCTGGTATTCCTATCAGTCATGCATCTTGTGATCAATTATCTTCATCCAACAAT
TATGGAGTGATTGGAGTTTCTGCTGATGAGTATGGAACAAACAGTCACTTCATGGATAATGCTAGAAG
TTCATACAAGAGAAAGAATGCTGAAGGAAATCCAGGGAATTTCCACTATCTGAATGCCTCAGCAAGCT
CTAGTTCCTCAGTTCCCCCAATGAATACAAGGCATCCCGAGGGGGTTGCTCTGATGGATGCTACATCA
TTCACCCTGCCACATTACAGGGGGACTAGTGCTTCATCAATCAGGGAAGTAGGATCTCAAAGAAGTGT
GAGGAATAGATTAGGTTCTGTGGGGCTCGATCCTGCCTTGACACACAACCCGAACCATTTTATTCAAG
GAAACTATTTGGGCCAACCCTATCAGCCAGGTGGCTCTCTCTGGTTAGAACAACACTTAAGCAACGGT
TCTACTGATGCAGGCGCTTCAGTATGGACTCAGACCCCTACTATTCCTTACATGCACGGGAACAATGT
CAATGGAGTTCCTATAGAAACTGGGAGCATGGGTCCACAGCGGTATCATGAGCCAGCTAGCAACAGAA
GTAATGCCAGTTTCTCGCACCCTTCTCCAGTAAACCCTCAGCACCATAATTTTCATCACCTGTCTCCA
CCAATTCAAGGAATTAGAGGTCACAATATTAATATTCTTCCTCAAGCACCAGCAGCTTCATTCAGAGT
TCCTACAGCCAATGCCTCACAAAGCACTATGAATCTATCTCAAGATGGTTTAGATATTGGACTTAGGA
ATCCGGGATCTGTTCAACCAACCGGCCTTCGAATGTACCGGCCTCGCCATGAGGGAGTTGCACCTGAG
ACCACACTAAGACATCGCAACCTCCCTCGCTTAAGAGTGTTGCCAACAGATGCAACAATACTAGGGTT
CCCTGACTATTATGAAGTAGAGAATTATGCTGACCACCACAGAGATATGCGCTTGGATATAGAGGACA
TGTCTTATGAGGAGCTTCTTGCACTTGGGGAGCGTATTGGTAATGTAAATACTGGCTTATCAGATGCA
ACTATCAGAAGTCAATTAAAAACAAGAACTTATTTATCATCTCCTTATTCAATCAATTTGGAAGTATC
TTGTATGGATCAAGAAGCTGATTCTTGCATTATTTGCCAGGATGATTATAAGAGTAAGGAGAAAATTG
CATCTCTTGATTGTGGACACGAGTATCATGCAGATTGCTTGAAGAAGTGGCTACGCTTGAAGAATGTC
TGCCCCATCTGCAAATCTGAAGCCTTAACCATGGAAGGAAAGGATGTTTAAGGTGGTGATCCTGCTTG
TATAAAATAAAAGGAAAAATAAAGCGGAGGAAAGGGGTGACAGCTTTATAGGCGAGCATTCAA

SEQ ID NO: 295 - protein - Populus trichocarpa
MGQRNMLCTNQMIDLEMDQQSQGYLHPESCILLGGVTNFRPPDIPTMLTASGNTINRDAHLADRYDGA
MFYGMPQYHGVHPHPQYHSPNLDLSVATAPNFYVPYMTPSSGIPISHASCDQLSSSNNYGVIGVSADE
YGTNSHFMDNARSSYKRKNAEGNPGNFHYLNASASSSSVPPMNTRHPEGVALMDATSFTLPHYRGTS
ASSIREVGSQRSVRNRLGSVGLDPALTHNPNHFIQGNYLGQPYQPGGSLWLEQHLSNGSTDAGASVWT
QTPTIPYMHGNNVNGVPIETGSMGPQRYHEPASNRSNASFSHPSPVNPQHHNFHHLSPPIQGIRGHNI
NILPQAPAASFRVPTANASQSTMNLSQDGLDIGLRNPGSVQPTGLRMYRPRHEGVAPETTLRHRNLPR
LRVLPTDATILGFPDYYEVENYADHHRDMRLDIEDMSYEELLALGERIGNVNTGLSDATIRSQLKTRT
YLSSPYSINLEVSCMDQEADSCIICQDDYKSKEKIASLDCGHEYHADCLKKWLRLKNVCPICKSEALT
MEGKDV

FIGURE 19 (continued)

SEQ ID NO: 296 - DNA - Populus trichocarpa
ATTTCAAGATATTATCAGTAGTCTTATTCGATGGACAATGATGGGAGAAAAGAGCCGGTGGAGGATGA
AGAGAGAAAACAGGCATCGAGTAGGGTCTGTTATACCCAACTCGAACAGGTTCATTCAGATTTTGCAA
TAGCAATGGTTTTGCAGGAACAAGAAAGGGCTTTCACAATCCTCACAAGCATCGAAAGCGATAGTAAC
GAGGAAGAAAGTGATGAAGCTTCAAGTTCTGAAAGCGGTGCTGATGACAATGACTATGAGTTCTTTCA
GAGCCATGAATTCGAATCTGAAATGGAATTTCTGCAGGAAGGAGAGGATAGTAACAGCGATGAAGATA
TGGAAGAGGATGAGGTTGACCCAGACGAGCTATCTTACGAAGACTTGATTGCGCTGGGAGAGTTTGTA
GGGCAAGAGAAGAGGGGACTGTCAAGAAATGAAATCTCTACGTGCTTGCGTCCATGTAAGTACGAGTC
TTTAGCAAGCAAAACTGGGACTGATCGGTGTGTGATTTGTCAAATGGAATATGAAGAAGATGAATCAT
TGGTAGCTCTTTCTTGTGATCATCCTTATCATCCTGAATGCATAGCCAACTGGCTTCAAATCAATAAG
ATTTGCCCCATTTGTACCACCGAAGTATCATCGCCTTATAAGAGTGTTTAGTTATTATCCATTTGATA
TGCGTTGTAAAATTCCCAAGATTCAAGATTAATTTGATTGTAACATTTGCGTTCATGTACTCG SEQ ID NO: 297 - protein - Populus trichocarpa
MDNDGRKEPVEDEERKQASSRVCYTQLEQVHSDFAIAMVLQEQERAFTILTSIESDSNEEESDEASSS
ESGADDNDYEFFQSHEFESEMEFLQEGEDSNSDEDMEEDEVDPDELSYEDLIALGEFVGQEKRGLSRN
EISTCLRPCKYESLASKTGTDRCVICQMEYEEDESLVALSCDHPYHPECIANWLQINKICPICTTEVS
SPYKSV SEQ ID NO: 298 - DNA - Medicago truncatula
ATGGATGAATATTCTAGTAAGAGAGCCAATGATGGGGTGATAGTTCCTAGAAAGGGGATGAGCACCAT
GTTTAAAGATACTGCCACTACCCGAGATCGAAATGGTCAAGTATGTAGCCGCCTTGGTTGCAGCAGCA
AAGTCAACTCTTCTAAAGGTGCTCAAATTGGTTCTTCTGAAAAGGGTAAATCTTTGAGGCCTTCATTT
CGGTTCTCATCAAATGGCAAGGAAACAATTGGTAGCTCCTCTAGAACGTTCTCCGGGAGTAGTAGCCC
AGGAAAACCCCATAGAAAGCCTCAGAAAAAGTTATCATCTCAGATAGAGACAGATTCATCTGAAACTA
ATAGTGTACAAGATGAACCAGAAGTTTCAAAGCTCACACCTCCACAAAAAAACCAGAGGGGTCTTCAA
GCCGAAGGGGAAAACACAGATTCTAGTAATGGGGTGCTGATGGAAGTAGGAAGTTCTAGTTTAGCCTC
TAATACAAGATCTAGGAGGAATTTTCATCCAAAACCTGGATTACGTAGTCAAGAAATTCAAAGCACCG
GTCCAGGGACACGTGCTGGTACCAGTAGGTATGGGTTAAGGAACCTCAAATGCAACTCCATTTCTGAT
GTCATGCCCGTCGGTTGTACACCATCTGATTCAACCCTAAACAAAAGAAGGATGCGATAAAAAAGAG
AAATTGTGAAGGAGAAAGTAGTTCTACAGCTAGAGGCAAAAAAATTAACGGGCCGTTAATTGATGGAC
GGAATTCTGTATCCAGAAATGGCCTATCTATCTCTGATTCAAGAATATCTAGAAATGCCCCTCATAGG
GACAGGGCAGACAGCAACATAGCGTCTGGTAGAACACGAAGATCAATTGGCGGTCATGGTAGGGGAAG
GGTTTCTGGCCAAGGAAATGCTAATCCTGTGGCCCCTAATCAGTCCCTTATCATGGTACCTTCCTTTT
CTTATTCTGGAAATCTTAATTCTCCTGGTGTACAACATCATAATTCTCTGGAGACTCCTTCAAGTCCA
AGTTCTTACAGTGGAGCAGGTACTAGTAGTGAGGAACTGTACGGTGTTATGCCAACGTCTCCTACAGA
ATACGGGCTCACCCATTCTCTAATAAATCGGGATAGCTTTCGACGACGCTACAACATGGATGGTATTG
CAGAGGTACTGTTGGCACTTGAGAGGATTGAACAAGATGTCGAGCTAACACACGAGCAAATTCACTTG
TTGGAGTCCAACTTGTTCCTTACTGGACTAAACTTCTTTGATCAGCATAGAGATATGCGACTGGACAT
CGATAATATGTCATATGAGGAATTACTGGCTCTGGAAGAAAGGATGGGTACTGTGAGCACCGCTGTAA
CAGAGGAAGATCTATCAGAATGCCTAAAGAGAAGTTTCTATCAATCCTCACCCTCAGACAATGCAACC
AAGTGTTGCAATGAGAATAAGGATGATATCAAATGCTGCATCTGCCAGGAGGAGTATGTGGAGGAAGA
TGAAGTGGGGAGTCTACTATGCGAGCACAAATATCATGTTGTTTGCATACAGCAGTGGCTACGACTAA FIGURE 19 (continued)

```
AGAACTGGTGTCCTATTTGCAAAGCATCAGTGACACCGTCAAGTTCGCCGTCGTCCCACTAGTTATGT
TTTAGGCCAGACAATGGATATTGATTTCTTTCTACCCCTCTTTCTGTTCATTTTAATTTTCACTTTTG
TACAAAATACAGTTTCTCTTCACCTCTTCTTATTAGTCTTTTGTACATAACCAATATCTTCATACCAA
TTATTATCAAATAATACAAGCCACTGGCTTGATAGAT
```

SEQ ID NO: 299 - protein - Medicago truncatula
```
MDEYSSKRANDGVIVPRKGMSTMFKDTATTRDRNGQVCSRLGCSSKVNSSKGAQIGSSEKGKSLRPSF
RFSSNGKETIGSSSRTFSGSSSPGKPHRKPQKKLSSQIETDSSETNSVQDEPEVSKLTPPQKNQRGLQ
AEGENTDSSNGVLMEVGSSSLASNTRSRRNFHPKPGLRSQEIQSTGPGTRAGTSRYGLRNLKCNSISD
VMPVGCTPSDSTLNKKKDAIKKRNCEGESSSTARGKKINGPLIDGRNSVSRNGLSISDSRISRNAPHR
DRADSNIASGRTRRSIGGHGRGRVSGQGNANPVAPNQSLIMVPSFSYSGNLNSPGVQHHNSLETPSSP
SSYSGAGTSSEELYGVMPTSPTEYGLTHSLINRDSFRRRYNMDGIAEVLLALERIEQDVELTHEQIHL
LESNLFLTGLNFFDQHRDMRLDIDNMSYEELLALEERMGTVSTAVTEEDLSECLKRSFYQSSPSDNAT
KCCNENKDDIKCCICQEEYVEEDEVGSLLCEHKYHVVCIQQWLRLKNWCPICKASVTPSSSPSSH
```

SEQ ID NO: 300 - DNA - Medicago truncatula
```
ATGATGCAAGGGCCTAGTTCTAACGGCACTGATATGAATCATCAGTCTTCCTTGAATCATGCGCAAAA
TGCAGTAGATTTCCGGCTGTCAGATTATAGGGGGTCTTCTGGTGAGACTGCATGTTTACGTGGTACTG
GTCCTAATGTGAGCTTTAATGGCTGGAATACCGGTGAACCCAGTTCTGGACTGAATCTGGTCAACCAA
GTCAACGATGATGGTCTAAAATCTGAACAAAGGTTGTCTTCGTCATGCAGTGCTATTGCTGAGGATGG
TCTAAGACCCGAGGAAAGGCAATTACTTGGGAACCAATCCAGAATTCATCCTTCCTTTTTGCAAGGTT
CCAGCTCCAATCATACAGCCCAAGGTATTAATTTTGGTATGGAGCACATTGCTAACTCATCTGATCGC
GGGAAAGGTAAAGAAACTGGTAGCGGTGTTAATAACAACGATCCTTTTGGATTAGATAGAGAGAAGAC
ATCAATTGGCAGTTCTTCATTCAACCAAACAGGTGCTTCATCAGCAAGCTCTGGGTACATGGCATGGG
GAGATAGTGGCAGTTCAAGTTCTTCTTTAGCTAATTGGGGTCCTTCCTGCAAAAGAAAGGCCCTTGAA
GATAGTTCTATGCAACTGTGTACTGGAGGAAGCTCGAGTTCCCTTGTACAATCTGAAAATGGTTACTG
GCTTACTGATTCTGTTGATCTTAATGTTCCTGGAAGCTTAGGTGATTTGTCACCTTTAGAGGATTTCC
GTGTTACTAGCCCTCCATTTCAGCAGAATACAAGAAATGAAGTGAGACAAGAAGCTTCCAATGCGTTT
CCTTCAATGGTAAGTATTGCGGAAAATGTGGAAAGGCCTCTACGAAACTTTGATAGGAGAATGACCCA
TCTACATCATCCGGAATCTGTACCTCTCAATTTAACATCAACAGGGAGTGCTAGACATCATAATTATC
CTTCTCCGCATCAAATACCCGGCTCTCTCTCATTTAACGAATCCTTGGATTTAAGGTTAGCAGCTGGA
GTAACAGCTGCTAATTCTGCTGTGCCGCAAAACCAGTCACCATCCCTGCACATGCATCCTTTTCCGTG
GAATAGAGCTGCTAATCCTAGAGTGGCCAGATCTTCAAGTTCTTATAGCTCAGGAGAAAGAGCAGTAC
GTGATGATTTTAATTTAAGAATCTTCCCAAGAGATAGTACCGAGCATCCCATGAACATGCCTGCATCT
TCAGGACATGAACCTGCAGGTTGGTATTCATCTTCTAGTAATTTGAACAATGCTGGAGGCATACCTCC
TCCATCCTGGATTGGATCTACTTCAAACGTCCACTCGTTACCTAATCCTAGCTGGACATTTAACCATG
AAGTCCCAACAGAAATCTACAGAGAGTTTCAGAGTTCAGTCCCTGGTCCCTTTTCCTTCAATCAGC
TCAGCATCTGGTACTCATAATGGTCATTCCTCCTCTACTTCCGGCCCTCCTTCATTTTCTCAGGGTTC
TAGTAGTAATCAACCACATCCAAGACCATCATTTATGACGGAAAGAAGGGGTGGTGATGTTCTCTCTG
CTCCTCATTCATTGCGAACATTACCCTTTGACAATGAGGGGAGACGCCGGCTCATATCTGAGATTCGC
CAAGTCCTGCTAGCAATGCGGAGGGGTGAGAACTTACGAGCTGAGGATTATATGCTCTTTGACCCTTT
CCTATATCATGGCATGGCTGAAATGCACGACAGACACAGAGAAATGCGCCTTGACGTTGATAATATGT
CTTATGAGGAATTGTTGGCATTGGAGGAGCGTATAGGAGACGTAAGCACTGGACTGAGTGAAGATATA
ATTAATAAGTTGATGAAACAGCGATTTTACATGTCTCTCATGACAGAGTCTTCTTCTGATCTCGAACC
```

FIGURE 19 (continued)

```
TTGCTGTATCTGTCAGGAGGAATATGTTGATGGACAAAATCTCGGTTTGCTAGATTGTGGGCACGAGT
TCCACAGTAACTGCATCACACAGTGGCTAATGCAGAAGAATCTGTGCCCAATTTGCAAAACAACGGCC
TTGGCCTCGTGACGAGGAGAATCTCTCCCTCTTCACATATCATTTCCATTTATCAGTTTTTATCTTTT
GTTGGTTCTATCTATTACTTTGTTTTATTCAATGAACTTCCTCTCATCTTAGATTGGGAACGAAAACA
CACATAAAAAAATAGACATAAAGAAATATTGGTGGTTAAGCTCTATAGTAGAATTACATTTATACTGT
GATAATGGACAATTACATGTCCTTTATGATATCTAAAAGCACTTGAATTATATTATTGATTTTCATTA
TAAGTTTAAGACTGTTGA
```

SEQ ID NO: 301 - protein - Medicago truncatula
```
MMQGPSSNGTDMNHQSSLNHAQNAVDFRLSDYRGSSGETACLRGTGPNVSFNGWNTGEPSSGLNLVNQ
VNDDGLKSEQRLSSSCSAIAEDGLRPEERQLLGNQSRIHPSFLQGSSSNHTAQGINFGMEHIANSSDR
GKGKETGSGVNNNDPFGLDREKTSIGSSSFNQTGASSASSGYMAWGDSGSSSSLANWGPSCKRKALE
DSSMQLCTGGSSSSLVQSENGYWLTDSVDLNVPGSLGDLSPLEDFRVTSPPFQQNTRNEVRQEASNAF
PSMVSIAENVERPLRNFDRRMTHLHHPESVPLNLTSTGSARHHNYPSPHQIPGSLSFNESLDLRLAAG
VTAANSAVPQNQSPSLHMHPFPWNRAANPRVARSSSSYSSGERAVRDDFNLRIFPRDSTEHPMNMPAS
SGHEPAGWYSSSSNLNNAGGIPPPSWIGSTSNVHSLPNPSWTFNHEVPTENLQRVSEFSPWSLFPSIS
SASGTHNGHSSSTSGPPSFSQGSSSNQPHPRPSFMTERRGGDVLSAPHSLRTLPFDNEGRRRLISEIR
QVLLAMRRGENLRAEDYMLFDPFLYHGMAEMHDRHREMRLDVDNMSYEELLALEERIGDVSTGLSEDI
INKLMKQRFYMSLMTESSSDLEPCCICQEEYVDGQNLGLLDCGHEFHSNCITQWLMQKNLCPICKTTA
LAS
```

SEQ ID NO: 302 - DNA - Medicago truncatula
```
ATGGGGCATAGACACTTATTCAATGCATCTCCAATGTTTGAGGGCGAGGCTGACCCGAATTGGAATAA
TATGCTGACTGATCAACATCATGTGAACCATGGTGGGACCAGCTCTTCAGAAAATGGTTCTTTTATTT
ATCCTGTGGAAAATATGTCTATAGATAACATTTATTTCCCTTCTCATTGGAACGCCAACACAAGGTCA
AATGGATATGCATCCTCAGGCCCCAATATTGAAGTACCACCTCCTCATCAATTGGACACATCGGGCAC
TTCTACTAATGATCATTTATGCATTCGTCTAGTGCTGGACCTTTCTTTGCAGTATCTGAAAACTTTG
TACACCAGCCTTCTTCTTCCAATTATGACAGACAAGCATTTCATGTTGATAGTGGTTTTATTGATCTT
ACAATGGGGAGTGGACGAGCGCATCACAAGAGGAAGAGCCCTGGAATTCCTTCAGTCTATGAGAGAGG
CAGTTCAAGTGGGTATTTCAATGCTGGGACTTCAAGTGATCTTCCGATACCTCCAGAATCATGGCCAG
AGAAACCAAATATGGATCCTCAATATATGCCTTGGGATCATGCTGCTATGGCACCCACATTCAGAGGT
GCTGGTCTCTCAATGAAGGGTGAGAGTTCTGTAAGGAATGTTAGGAGCCGTTCTTCACTTGATTTGGA
ATCCAACCTGTGTAGGACCCATTTATCAAGTAGCCATTCACACAACTCGTATCCTACTGTCCCACCAG
TCAGCCATTCTAGCTTGGCGGATCTTTCTCAGGTTTCCACCTCTCTGACAAGGGATTGGAGCCAAATG
AACGTAACTCCTGCTAATGGAAGAGTGTTATTACCAGATGCTAGTACTTTTGGTCTTGAGACAAGTCA
CTTCCCTGTTGGAAATGCTGCTGCTGCTGCCGCTGCTAGTAATGCTACTGTAGATGTTGGAAGCTTCC
ATCATGATTTTGGCACAAGCAGAAACCCTACTACTGCTCAAAGTTTTCAAAATTTAACTCAGACTGCT
AGGGGAACTCGAAGTAATTACTCTCAGAGATCCACTCCAGCTTATAGGGCTTCTTCAAGCTTGCGCTT
GGGTCAAGCGACACCTTCAGATAATGGGTTGCCCATGGTAGCTGAAGGTTACCCTTCTAGACATCCAA
GGCCATTGAACACTGTTGGCTGGCGGAACAGTGACAGAAATGGAAGGTCAAGAATTTCTAGTGAAAGA
TATAGATCACTGGCTGATCAGGCTGCTCTCCATGCAAGATTATCATCCTCTGAGGTACCGGGTTTTAT
GATTGTTGAGCGTGCCTCACTATATGGTTCTAGGAATGTGCTTGATCAGCACAGAGAAATGAGGATGG
ACATTGATAACATGAGCTATGAGGAACTACTTGCACTTGGGGAGAGGATTGGCCAAGTGAACACAGGA
TTGTCTGAGGATGTTCTTTCCAAGTGTGTGACAGAAACAATATATTGTTCATCTGACCAATGTCAGGA
```

```
TGAAGGAAGCTGTGTGATCTGTCTGGAAGAGTACAAGAACATGGACGATGTTGGGACACTTAAAACTT
GTGGACATGACTACCATGTAAGCTGCATCAAAAAGTGGTTATCTATGAAGAAACTATGTCCTATCTGC
AAATCTTCTGCTTTGCCTGAGGATAAGAAGGATAAATAATTTATACTATAGTATTTATAGTATTTATT
GATCTCATTTGTACATATATTTGGACGTCCTTCAAATTGAGGAAACAGACTGGCTTTTGGAAATGGTG
TAACAAGAATGCTACTGCATGTCAATGTATTTGTTTGGCTTCGATCTTAATTTAGTGAAGCCTAGAAA
TCATTGTGAATTTGAAACGGATCTGGTTTGCTTCTATTTTAATAACAAAAGAAACTA
```

SEQ ID NO: 303 - protein - Medicago truncatula
```
MGHRHLFNASPMFEGEADPNWNNMLTDQHHVNHGGTSSSENGSFIYPVENMSIDNIYFPSHWNANTRS
NGYASSGPNIEVPPPHQLDTSGTSTNDHFMHSSSAGPFFAVSENFVHQPSSSNYDRQAFHVDSGFIDL
TMGSGRAHHKRKSPGIPSVYERGSSSGYFNAGTSSDLPIPPESWPEKPNMDPQYMPWDHAAMAPTFRG
AGLSMKGESSVRNVRSRSSLDLESNLCRTHLSSSHSHNSYPTVPPVSHSSLADLSQVSTSLTRDWSQM
NVTPANGRVLLPDASTFGLETSHFPVGNAAAAAAASNATVDVGSFHHDFGTSRNPTTAQSFQNLTQTA
RGTRSNYSQRSTPAYRASSSLRLGQATPSDNGLPMVAEGYPSRHPRPLNTVGWRNSDRNGRSRISSER
YRSLADQAALHARLSSSEVPGFMIVERASLYGSRNVLDQHREMRMDIDNMSYEELLALGERIGQVNTG
LSEDVLSKCVTETIYCSSDQCQDEGSCVICLEEYKNMDDVGTLKTCGHDYHVSCIKKWLSMKKLCPIC
KSSALPEDKKDK
```

SEQ ID NO: 304 - DNA - Medicago truncatula
```
ATGCAAGGGCAGAGAGGCACAATTGGTTCCTCATCTGAAACCTTCGAGTTTGATTGTGGATCTACATC
AAGTACTGCTGCTGTTGATCAGCACATTTTTTGGAATAATATGCACACTCCTGCCGAAAATCGGATAC
CCGAGTTTATGCTTTCCCCAAGTGAGATGAACCCGCCTCACGGGAATTCTCTAAACCATGAATGGCAG
AACTTGAGCGGATGGAGCTTAGGAGAACCAAGTTCCAGTAATACACAGAACGAAGTTAACAACAATGA
GCTGAAAAGGGAGTTAGGGTTATCACCTCCGATAAATGGTGGTGCTATAGCTGGTCCAAGACTAGAAG
AAAGGCACTTTGAACCAACTAGTGCATTTTCATTGGATAACGTCAATACAGGTCCTATGTATATGTGC
AGCCCCAATTCTCATTTGGTACCACAAAATCTCAATTTAAATGCCAGTTTAACAGATAATGGCATCGA
TAATAGCTATCATGTGGAAGTTGAACATCCCAACATGCACAAATCCAGTGGTCCTCTAAATGAGCATA
TTCCACCTCCGATTACTTCTGGTTCTTTTTTGCTTCCTTCTGGTGGAAGTAACAGCATTTATCTCGGG
GATACCGATGGTCGGCCAGGTTGTTCTCTAGACACCCGCCGTGTATCTTGTAAACGAAAGGCAGTTGA
AGGAAATGGTGGACAATCTTCAGACGGTGGAAGTTCTAGCTATAGCCAGCATACAGTTGGCAGTGCTT
GGAATACTCTTCCTACTCAGGATTATGCAGGGAGCAATTTTAACCAATCTGCACCGGCAGAACAGGTG
AATGCAAGACTTGGCCTGAGTGTCGGGGACGGATCTTCTGAAACCATACCTGGGTCAACTGTTGCAGG
AAGCTCGGAAAGCTTCCACAGAAATTTTCGTTTGAGGATAAATCCTTCAAGCCAACAAATTTCTCTTC
CTCCAGCCACATTCTCACATGGGAGTGTGATCAGAAACTCTAGTGTTCCTTCATCTGCTCCAATGTTG
CAAAGGTACCACCCTATCAATAATCCTCTGGACTTGAGGTCAGTACAACCAGTAAATGTGATGCATCC
TCAAAGCGAACCTCTTCTGGTTCATGTTCCTGCGTTACCGAGGAGTGCGCAATCCATCAGGTGGAGTG
GTGGTTCTAGCTCAACAAACAACCATTCGTCAAATTCAGTTTTAGGCTTAGATAGGGATACTCAACCA
CATGAGGAAGCAGGCTCAAGAGCTATGGCTAGAAACATTTTAGATCACCCAGTGTTTGTACCTGCAAA
TGTAAGAAATGCGGCTCGAAATCCAGCTAGGTCTTCGAGCAGTGCAAACTTAAGTATTCCAGGAAATG
TTGCTTCGTCATCAAGAACTGCACCAAATCCTCCAGCTTTGAATCCATCATCTGTCTCGGCGTGGGTT
TCTCGTCCTAATCCTCAGCAGTATCCTCGCAGGTTATCTGAATATGTCCGTCGGTCCTTGTTTTCTCC
CGGTTCTGAAGGTGGAAGTTCAAGCAATAACTATCCTTCCTTGCGTGGTCCTTCCACTTCGTCAGAAT
CAAGAAATCTGCCATCTGGGACCAACCCTGGATCATCTCCATGGATGGAGAGGTCAGCTGATAGTGAA
TTTGGAATTCCCTATTCCTTACGATCGTTGGCTGCTGCTGGTGAAGGAAGTAGTAGACTTGTATCCGA
```

FIGURE 19 (continued)

```
GCTCCGCAATGTGTTGGGCATCATGCGTAGGGGTGGGAACCTGCGGTTTGAGGATGTTATGATTCTCG
ACCATTCAATGTTTGCTGGGATTGCTGATATGCATGATAGGCACAGGGATATGCGGCTTGATGTTGAT
AACATGTCTTACGAGGAGTTATTGGCTCTGGAAGAACGCATTGGAAATGTCAGCACAGGATTGAATGA
GGAGACCATTATGAAACATTTGAAACAGAAGAAATACTCAGTTGATGGATTGGGTTCACAGAGTGAGA
CAGAACCCTGCTGTGTTTGTCAGGAGGAGTTTAAAAATGAAGATGATATTGGATCATTGGATTGCGGG
CATGATTATCACATCGACTGTATTAAACAGTGGCTAACCCATAAGAATATCTGTCCAATTTGTAAGAC
AACAGGCTTGGCAACATGAGGCTTGTGACTCATATATTCTATTCTATCTTATTATAAGATAAGATGAA
CACATAGAGGTCAAGAAAACTGGCACAATTAGTCAGGAAAATTCTGCTTAATTGAAGTTGAAGTTTCT
GGTGCCTTTGTTACTTATTAAATGGCCGTTAAGATTTAGCCAAATTTTCTTTATTATCATTTTTTGTT
TTATTTGGGGAAACCAATTATCTCCCGGTTAAGGTGAAACATGAGATGATTGGTGTTGGATGAAGGAA
TATTTCTAAACTCTAGCTGATAAGATTGTTTTACATTTGGGGAAATTTCTAT
```

SEQ ID NO: 305 - protein - Medicago truncatula
```
MQGQRGTIGSSSETFEFDCGSTSSTAAVDQHIFWNNMHTPAENRIPEFMLSPSEMNPPHGNSLNHEWQ
NLSGWSLGEPSSSNTQNEVNNNELKRELGLSPPINGGAIAGPRLEERHFEPTSAFSLDNVNTGPMYMC
SPNSHLVPQNLNLNASLTDNGIDNSYHVEVEHPNMHKSSGPLNEHIPPPITSGSFLLPSGGSNSIYLG
DTDGRPGCSLDTRRVSCKRKAVEGNGGQSSDGGSSSYSQHTVGSAWNTLPTQDYAGSNFNQSAPAEQV
NARLGLSVGDGSSETIPGSTVAGSSESFHRNFRLRINPSSQQISLPPATFSHGSVIRNSSVPSSAPML
QRYHPINNPLDLRSVQPVNVMHPQSEPLLVHVPALPRSAQSIRWSGGSSSTNNHSSNSVLGLDRDTQP
HEEAGSRAMARNILDHPVFVPANVRNAARNPARSSSSANLSIPGNVASSSRTAPNPPALNPSSVSAWV
SRPNPQQYPRRLSEYVRRSLFSPGSEGGSSSNNYPSLRGPSTSSESRNLPSGTNPGSSPWMERSADSE
FGIPYSLRSLAAAGEGSSRLVSELRNVLGIMRRGGNLRFEDVMILDHSMFAGIADMHDRHRDMRLDVD
NMSYEELLALEERIGNVSTGLNEETIMKHLKQKKYSVDGLGSQSETEPCCVCQEEFKNEDDIGSLDCG
HDYHIDCIKQWLTHKNICPICKTTGLAT
```

SEQ ID NO: 306 - protein - ZfC3HC4_Orysa_ARKL1
```
CERKCSICQEEYSDGEEVGKMVCKHYYHFSCIKNWLRQKNWCPICKSVALNT
```

SEQ ID NO: 307 - protein - ZfC3HC4_Orysa_ARKL3
```
DDIKCSICQEEYIEGEEVGRLGCEHQYHVCCIHQWLRQKNWCPICKASAEPS
```

SEQ ID NO: 308 - protein - ZfC3HC4_Orysa_ARKL4
```
VEPCCICQEEYAEGEDMGRLDCGHDFHTACIKQWLVIKNLCPICKKTGLGT
```

SEQ ID NO: 309 - protein - ZfC3HC4_Orysa_ARKL5
```
DDGKCAICLEEYKDNSLLGILKCNHDFHTDCVKKWLKEKNSCPICKSAAA
```

SEQ ID NO: 310 - protein - ZfC3HC4_Orysa_ARKL6
```
VERNCSICQEEFEANEETGRLICGHSYHVQCIKQWLSRKNTCPVCKTVVSKT
```

SEQ ID NO: 311 - protein - ZfC3HC4_Orysa_ARKL7
```
DNERCVICLEEYKHEDTLGRLKCGHGFHCNCIKKWLQVKNTCPVCKAAAADE
```

FIGURE 19 (continued)

SEQ ID NO: 312 - protein - ZfC3HC4_Orysa_ARKL8
EKDACIICQEEYEAKELVGTLGCHKYHAMCIKGWLMVKNLCPICKTTALPA

SEQ ID NO: 313 - protein - ZfC3HC4_Orysa_ARKL9
MEQCVICRVEFEEGESLVALPCKHSYHSECINQWLQLNKVCPMCSAEVPTS

SEQ ID NO: 314 - protein - ZfC3HC4_Zeama_ARKL1
MERKCSICQEEFETNEEMGRLDCGHSYHVYCIKQWLSQKNICPVCKTAVSKN

SEQ ID NO: 315 - protein - ZfC3HC4_Zeama_ARKL2
DPEPCCICQEEYADGDDLGRLDCGHDFHAGCIKQWLVVKNVCPICKSTALKK

SEQ ID NO: 316 - protein - ZfC3HC4_Horvu_ARKL1
DDIKCSICQEEFVKGEEVGRLRCEHQYHVCCIRQWLLQKNWCPVCKAPALPS

SEQ ID NO: 317 - protein - ZfC3HC4_Horvu_ARKL2
EFEPCCICQEDYVEGDDLGTLHCGHDFHASCISQWLVVKNLCPICKSTALKT

SEQ ID NO: 318 - protein - ZfC3HC4_Horvu_ARKL3
CDRKCSICQEEYSGGEEVGNMACKHYYHITCIQHWLRQKNWCPICKSVAAKT

SEQ ID NO: 319 - protein - ZfC3HC4_Lyces_ARKL1
LERQCTICQEEYEAEDEMGKLDCGHFYHIRCIKQWLSQKNSCPVCKSAAMSN

SEQ ID NO: 320 - protein - ZfC3HC4_Lyces_ARKL2
DAEPCCICQEEYKDGEDLGKLDCGHDFHADCVKQWLMQKNLCPICKTTGLNT

SEQ ID NO: 321 - protein - ZfC3HC4_Lyces_ARKL3
DDIKCSICQEEYVIGDEIGNLGCEHGYHMECIKQWFKLKNWCPICKAAVESS

SEQ ID NO: 322 - protein - ZfC3HC4_Glyma_ARKL1
DAEPCCVCQEDYGDGNDIGTLDCGHDFHSSCIKQWLMQKNLCPICKTTGLAT

SEQ ID NO: 323 - protein - ZfC3HC4_Glyma_ARKL2
DAEPCCVCQEDYGDGNDIGTLDCGHDFHSSCIKQWLMHKNLCPICKTTGLAT

SEQ ID NO: 324 - protein - ZfC3HC4_Zinel_ARKL1
RCRPCCICQEEYKDGDDLGTLDCTHDFHYGCIKQWLQQKNLCPTCKSTGFAS

SEQ ID NO: 325 - protein - ZfC3HC4_Lotja_ARKL1
EGSCVICLEEYKNMDDVGTLKTCGHDYHVNCIKKWLSMKKLCPICKASVMPE

SEQ ID NO: 326 - protein - ZfC3HC4_Arath_ARKL1
EDAKCSICQEEYTIGDEVGRLHCEHTYHVKCVQEWLRIKSWCPICKATAETS

FIGURE 19 (continued)

SEQ ID NO: 327 - protein - ZfC3HC4_Arath_ARKL2
ETEPCTICQESFKNEEKIATLDCGHEYHAECLEKWLIVKNVCPICKSEALVM

SEQ ID NO: 328 - protein - ZfC3HC4_Arath_ARKL3
QRKCAICLEEYKEKEELGEVKGCGHDYHGRCIKKWLSMKNSCPICKSPALPD

SEQ ID NO: 329 - protein - ZfC3HC4_Arath_ARKL4
DDVKCSICQEEYVDGDEVGTLPCQHKYHVSCAQQWLRMKNWCPICKTSAESQ

SEQ ID NO: 330 - protein - ZfC3HC4_Arath_ARKL5
DAEPCCVCQEEYTEGEDMGTLECGHEFHSQCIKEWLKQKNLCPICKTTGLNT

SEQ ID NO: 331 - protein - ZfC3HC4_Arath_ARKL6
DMEPCCVCQEEYAEGDDLGTLGCGHEFHTACVKQWLMLKNLCPICKTVALST

SEQ ID NO: 332 - protein - ZfC3HC4_Arath_ARKL7
EVEPCCVCQEEYKEEEEIGRLECGHDFHSQCIKEWLKQKNLCPICKTTGLNT

SEQ ID NO: 333 - protein - ZfC3HC4_Arath_ARKL8
NIEPCCICQEEYVEGDNLGTLKCGHEFHKDCIKQWVMIKNLCPICKTEALKT

SEQ ID NO: 334 - protein - ZfC3HC4_Arath_ARKL9
VDRKCSICQDEYEREDEVGELNCGHSFHVHCVKQWLSRKNACPVCKKAAYGK

SEQ ID NO: 335 - protein - ZfC3HC4_Arath_ARKL10
DDIKCSICQEEYVDGDELGTIPCQHMYHVSCVQQWLRMKNWCPICKTSAEEE

SEQ ID NO: 336 - protein - ZfC3HC4_Arath_ARKL11
ETDSCTICQENYKNEDKIATLDCMHKYHAECLKKWLVIKNVCPICKSEALVI

SEQ ID NO: 337 - protein - ZfC3HC4_Arath_ARKL12
ADRKCIICQDEYEAKDEVGELRCGHRFHIDCVNQWLVRKNSCPVCKTMAYNK

SEQ ID NO: 338 - protein - ZfC3HC4_Poptr_ARKL1
DDIKCSICQEEYVVGDEVGRLQCEHGYHMSCIHQWLSLKNWCPICKASVAPS

SEQ ID NO: 339 - protein - ZfC3HC4_Poptr_ARKL2
EAEPCCICQEEYNDGEDLGTLDCGHDFHAGCVKQWLMHKNWCPICKTTGLAT

SEQ ID NO: 340 - protein - ZfC3HC4_Poptr_ARKL3
DLEPCCICQEEYVDGDDMGIIDCGHDFHTNCIKQWLMQKNLCPICKMTALLT

SEQ ID NO: 341 - protein - ZfC3HC4_Poptr_ARKL4
DLEPCCICQEEYVDGDDMGIIDCGHDFHTNCIKQWLMQKNLCPICKMTALLT

FIGURE 19 (continued)

SEQ ID NO: 342 - protein - ZfC3HC4_Poptr_ARKL5
DLEPCCICQEEYVDGDDMGIIDCGHDFHANCIKQWLMQKNLCPICKMTALIT

SEQ ID NO: 343 - protein - ZfC3HC4_Poptr_ARKL6
LEKKCSICQDDYEEDGEVGKLDCGHGFHIQCIKQWLGQKNTCPVCKTEPVGR

SEQ ID NO: 344 - protein - ZfC3HC4_Poptr_ARKL7
ETSCAICLEEYKSMDKVGMIRNCGHVYHVDCIKKWLSMKNMCPICKAPAVAD

SEQ ID NO: 345 - protein - ZfC3HC4_Poptr_ARKL8
EADSCIICQDDYKSKEKIAALDCGHEYHAVCLKKWLRLKNVCPICKSEALNT

SEQ ID NO: 346 - protein - ZfC3HC4_Poptr_ARKL9
EADSCIICQDDYKSKEKIASLDCGHEYHADCLKKWLRLKNVCPICKSEALTM

SEQ ID NO: 347 - protein - ZfC3HC4_Poptr_ARKL10
DRCVICQMEYEEDESLVALSCDHPYHPECIANWLQINKICPICTTEVSSP

SEQ ID NO: 348 - protein - ZfC3HC4_Medtr_ARKL1
DDIKCCICQEEYVEEDEVGSLLCEHKYHVVCIQQWLRLKNWCPICKASVTPS

SEQ ID NO: 349 - protein - ZfC3HC4_Medtr_ARKL2
DLEPCCICQEEYVDGQNLGLLDCGHEFHSNCITQWLMQKNLCPICKTTALAS

SEQ ID NO: 350 - protein - ZfC3HC4_Medtr_ARKL3
EGSCVICLEEYKNMDDVGTLKTCGHDYHVSCIKKWLSMKKLCPICKSSALPE

SEQ ID NO: 351 - protein - ZfC3HC4_Medtr_ARKL4
ETEPCCVCQEEFKNEDDIGSLDCGHDYHIDCIKQWLTHKNICPICKTTGLAT

SEQ ID NO: 352 - protein - PfamB2828_Orysa_ARKL1
FNDRYRGMRMDIDGMSYEELLALGDRIGTVSTGLSEDALSKCLD

SEQ ID NO: 353 - protein - PfamB2828_Orysa_ARKL2
FNDRYRGMRMDIDGMSYEELLALGDRIGTVSTGLSEDALSKCLD

SEQ ID NO: 354 - protein - PfamB2828_Orysa_ARKL3
SHDQHSDMRMDIDNMSYEELLALGDRIGSVSTALSEEQFVKCLR

SEQ ID NO: 355 - protein - PfamB2828_Orysa_ARKL4
LIDRHRDMRLDVDNMSYEELLALGERIGYVNTGLSEDKIRTGLK

SEQ ID NO: 356 - protein - PfamB2828_Orysa_ARKL5
AQDPHRAMRLDIDNMSYEDLLALGESIGNVCTGLVDEKISGCVR

FIGURE 19 (continued)

SEQ ID NO: 357 - protein - PfamB2828_Orysa_ARKL6
MHDQHQDWRLDVDNMTYEELLDLEDRIGYVSTGLHDDEIARSLR

SEQ ID NO: 358 - protein - PfamB2828_Orysa_ARKL7
AFDPHWDMRLDIDDMSYEELLALEERIGHVNTGLADEKISGCVM

SEQ ID NO: 359 - protein - PfamB2828_Orysa_ARKL8
VIDEHRDMRLDVDSMTYEELVALEERIGNVNSGFTESYIEENLK

SEQ ID NO: 360 - protein - PfamB2828_Orysa_ARKL9
DDPQDAWEDVDPDEYSYEELVALGEVVGTESRGLSADTLASLPS

SEQ ID NO: 361 - protein - PfamB2828_Zeama_ARKL1
MYDRYQDWRLDVDNMTYEELLELGDKIGYVNTGLRDDEITRNLR

SEQ ID NO: 362 - protein - PfamB2828_Zeama_ARKL2
IHDRHRDMRLDIDNMSYEELLALEERIGNVGTGLSEEAVIRLLK

SEQ ID NO: 363 - protein - PfamB2828_Horvu_ARKL1
SHDHHSDMRMDIDNMSYEELLALEERIGFVSTALSEEQFAKCIR

SEQ ID NO: 364 - protein - PfamB2828_Horvu_ARKL2
IHDRHRDMRLDIDNMSYEELLALEERIGNVSTGLTENDVMKLLK

SEQ ID NO: 365 - protein - PfamB2828_Horvu_ARKL3
LSDRHRAMRMDIDGMSYEELLALGDRIGTVNTGLSEDALYKCLK

SEQ ID NO: 366 - protein - PfamB2828_Lyces_ARKL1
GLDRYRNWRLDVDNMSYEELLELGDRIGYVNTGLREDEIARCVR

SEQ ID NO: 367 - protein - PfamB2828_Lyces_ARKL2
IQDRHRDMRLDVDNMSYEELLALEERIGNVCTGLTEETILNRLK

SEQ ID NO: 368 - protein - PfamB2828_Lyces_ARKL3
FYDQHRDMRLDIDDMSYEELLALEERIGSVSTALPEEELLKCLR

SEQ ID NO: 369 - protein - PfamB2828_Glyma_ARKL1
VHDRHGDMRLDVDNMSYEELLALEERIGNVSTGLSEETLSKLLK

SEQ ID NO: 370 - protein - PfamB2828_Glyma_ARKL2
VHDRHRDMRLDVDNMSYEELLALEERIGNVSTGLSEETLSKLLK

SEQ ID NO: 371 - protein - PfamB2828_Zinel_ARKL1
IHDRHRDMRLDIDNMSYEELLALEERIGNVNTGLTEETILKHIR

FIGURE 19 (continued)

SEQ ID NO: 372 - protein - PfamB2828_Lotja_ARKL1
MLDQHRDMRMDIDNMSYEELLALGERIGHVNTGLSEDSFSQCMT

SEQ ID NO: 373 - protein - PfamB2828_Arath_ARKL1
FHDQHRDMRLDIDNMSYEELLALEERIGTVSTALTEEAISKCLK

SEQ ID NO: 374 - protein - PfamB2828_Arath_ARKL2
HIDHHRDMRLDIEEMSYEELLALSERIGTVNTGLPEEDVKNHLK

SEQ ID NO: 375 - protein - PfamB2828_Arath_ARKL3
MLDHHRDMRLDIDNMSYEELLDLGERIGSVNTGLSDSAISSCLL

SEQ ID NO: 376 - protein - PfamB2828_Arath_ARKL4
FHDQHRDMRLDIDNMSYEELLALEEKMGTVSTALSEEALLKSLK

SEQ ID NO: 377 - protein - PfamB2828_Arath_ARKL5
GHDRYRDMRLDVDNMSYEELLALEERIGDVCTGVNEETISNRLK

SEQ ID NO: 378 - protein - PfamB2828_Arath_ARKL6
MHDRHRDMRLDVDNMSYEELLALGERIGDVSTGLSEEVILKVMK

SEQ ID NO: 379 - protein - PfamB2828_Arath_ARKL7
IHDRYRDMRLDVDNMTYEELLSLEERIGDVCTGLNEETISNRLK

SEQ ID NO: 380 - protein - PfamB2828_Arath_ARKL8
MHDRHREMRLDVDNMSYEELLALGERIGDVSTGLSEEVILKAMK

SEQ ID NO: 381 - protein - PfamB2828_Arath_ARKL9
SRDNYHELRLDVDSMSYEQLLELGDRIGYVNTGLKESEIHRCLG

SEQ ID NO: 382 - protein - PfamB2828_Arath_ARKL10
FYDQHRDMRLDIDNMSYEELLALGDKMGTVSTALSEEALSRSLK

SEQ ID NO: 383 - protein - PfamB2828_Arath_ARKL11
YVDHHQDMRLDIEDMSYEELLALSDQIGTVKTGLSSEDVKELLK

SEQ ID NO: 384 - protein - PfamB2828_Arath_ARKL12
SFDQFRDMRLNVDNMTYEQLLELGERIGHVNTGLTEKQIKSCLR

SEQ ID NO: 385 - protein - PfamB2828_Poptr_ARKL1
FHDQHRDMRLDIDNMSYEELLALEERMGTVSTALTEEALSECLK

SEQ ID NO: 386 - protein - PfamB2828_Poptr_ARKL2
MYDRHRDMRLDVDNMSYEELLALEERIGNVSTGLSEETIVNNLK

FIGURE 19 (continued)

SEQ ID NO: 387 - protein - PfamB2828_Poptr_ARKL3
MHDRHRDMRLDVDNMSYEELLALEERIGDVSTGLSEETILKLLK SEQ ID NO: 388 - protein - PfamB2828_Poptr_ARKL4
MHDRHRDMRLDVDNMSYEELLALEERIGDVSTGLSEETILKLLK SEQ ID NO: 389 - protein - PfamB2828_Poptr_ARKL5
MHDQHRDMRLDVDNMSYEELLALEERIGDVSTGLSGETILKLMK SEQ ID NO: 390 - protein - PfamB2828_Poptr_ARKL6
RMDRFSNWRLDIDHMTYEQLLDLGDRIGYVNTGLKEDEISRCVK SEQ ID NO: 391 - protein - PfamB2828_Poptr_ARKL7
FLDQYRDMRLDVDSMSYEELLALGERIGIVNTGLPEDVFSKCLV SEQ ID NO: 392 - protein - PfamB2828_Poptr_ARKL8
HVDHHRDMRLDIEDMSYEELLALGERIGNVNTGLSEGTIRSQLK SEQ ID NO: 393 - protein - PfamB2828_Poptr_ARKL9
YADHHRDMRLDIEDMSYEELLALGERIGNVNTGLSDATIRSQLK SEQ ID NO: 394 - protein - PfamB2828_Poptr_ARKL10
SDEDMEEDEVDPDELSYEDLIALGEFVGQEKRGLSRNEISTCLR SEQ ID NO: 395 - protein - PfamB2828_Medtr_ARKL1
FFDQHRDMRLDIDNMSYEELLALEERMGTVSTAVTEEDLSECLK SEQ ID NO: 396 - protein - PfamB2828_Medtr_ARKL2
MHDRHREMRLDVDNMSYEELLALEERIGDVSTGLSEDIINKLMK SEQ ID NO: 397 - protein - PfamB2828_Medtr_ARKL3
VLDQHREMRMDIDNMSYEELLALGERIGQVNTGLSEDVLSKCVT SEQ ID NO: 398 - protein - PfamB2828_Medtr_ARKL4
MHDRHRDMRLDVDNMSYEELLALEERIGNVSTGLNEETIMKHLK SEQ ID NO: 399 - protein - Motif 1
YE(Q/E)L(L/I)XL SEQ ID NO: 400 - protein - RING domain consensus sequence
CXXCXXXXXXXXXXXXXXXXXXXXXXXXXXXXXXXXXXCXXXHXXXHXXCXXXXXXXXXXXXX
XXXXXXXXXXXXXXXXXXXXXXXXXXXXCXXC

FIGURE 19 (continued)

SEQ ID NO: 401 - protein - RING domain ARKL proteins consensus sequence
CX(I/V)C(Q/1)EE(Y/F)X6(G/V)X3CX1HX2HX2CX2WLX5CX2C

SEQ ID NO: 402 - protein - RING domain of ARK protein of Mus musculus
DTEEKCTICLSILEEGEDVRRLPCMHLFHQVCVDQWLITNKKCPICR

SEQ ID NO: 403 - protein - RING domain of Goliath protein of Mus musculus
RTGEINIAVTKEWFIIASFGLLSALTLCYMIIRATASLNANEVEWF

SEQ ID NO: 404 - DNA - primer 1
GGGGACAAGTTTGTACAAAAAAGCAGGCTTAAACAATGGATGATCACATGGGAAGA

SEQ ID NO: 405 - DNA - primer 2
GGGGACCACTTTGTACAAGAAAGCTGGGTTTTGGTTTCTGAAGAAGCACC

SEQ ID NO: 406 - DNA - Oryza sativa - promoter sequence
AATCCGAAAAGTTTCTGCACCGTTTTCACCCCCTAACTAACAATATAGGGAACGTGTGCTAAATATAA
AATGAGACCTTATATATGTAGCGCTGATAACTAGAACTATGCAAGAAAAACTCATCCACCTACTTTAG
TGGCAATCGGGCTAAATAAAAAAGAGTCGCTACACTAGTTTCGTTTTCCTTAGTAATTAAGTGGGAAA
ATGAAATCATTATTGCTTAGAATATACGTTCACATCTCTGTCATGAAGTTAAATTATTCGAGGTAGCC
ATAATTGTCATCAAACTCTTCTTGAATAAAAAAATCTTTCTAGCTGAACTCAATGGGTAAAGAGAGAG
ATTTTTTTAAAAAAATAGAATGAAGATATTCTGAACGTATTGGCAAAGATTTAAACATATAATTATA
TAATTTTATAGTTTGTGCATTCGTCATATCGCACATCATTAAGGACATGTCTTACTCCATCCCAATTT
TTATTTAGTAATTAAAGACAATTGACTTATTTTTATTATTTATCTTTTTTCGATTAGATGCAAGGTAC
TTACGCACACACTTTGTGCTCATGTGCATGTGTGAGTGCACCTCCTCAATACACGTTCAACTAGCAAC
ACATCTCTAATATCACTCGCCTATTTAATACATTTAGGTAGCAATATCTGAATTCAAGCACTCCACCA
TCACCAGACCACTTTTAATAATATCTAAAATACAAAAAATAATTTTACAGAATAGCATGAAAAGTATG
AAACGAACTATTTAGGTTTTTCACATACAAAAAAAAAAAGAATTTTGCTCGTGCGCGAGCGCCAATCT
CCCATATTGGGCACACAGGCAACAACAGAGTGGCTGCCCACAGAACAACCCACAAAAAACGATGATCT
AACGGAGGACAGCAAGTCCGCAACAACCTTTTAACAGCAGGCTTTGCGGCCAGGAGAGAGGAGGAGAG
GCAAAGAAAACCAAGCATCCTCCTCCTCCCATCTATAAATTCCTCCCCCCTTTTCCCCTCTCTATATA
GGAGGCATCCAAGCCAAGAAGAGGGAGAGCACCAAGGACACGCGACTAGCAGAAGCCGAGCGACCGCC
TTCTTCGATCCATATCTTCCGGTCGAGTTCTTGGTCGATCTCTTCCTCCTCCACCTCCTCCTCACAG
GGTATGTGCCCTTCGGTTGTTCTTGGATTTATTGTTCTAGGTTGTGTAGTACGGGCGTTGATGTTAGG
AAAGGGGATCTGTATCTGTGATGATTCCTGTTCTTGGATTTGGGATAGAGGGGTTCTTGATGTTGCAT
GTTATCGGTTCGGTTTGATTAGTAGTATGGTTTTCAATCGTCTGGAGAGCTCTATGGAAATGAAATGG
TTTAGGGTACGGAATCTTGCGATTTTGTGAGTACCTTTTGTTTGAGGTAAAATCAGAGCACCGGTGAT
TTTGCTTGGTGTAATAAAAGTACGGTTGTTTGGTCCTCGATTCTGGTAGTGATGCTTCTCGATTTGAC
GAAGCTATCCTTTGTTTATTCCCTATTGAACAAAATAATCCAACTTTGAAGACGGTCCCGTTGATGA
GATTGAATGATTGATTCTTAAGCCTGTCCAAAATTTCGCAGCTGGCTTGTTTAGATACAGTAGTCCCC
ATCACGAAATTCATGGAAACAGTTATAATCCTCAGGAACAGGGGATTCCCTGTTCTTCCGATTTGCTT FIGURE 19 (continued)

```
TAGTCCCAGAATTTTTTTTCCCAAATATCTTAAAAAGTCACTTTCTGGTTCAGTTCAATGAATTGATT
GCTACAAATAATGCTTTTATAGCGTTATCCTAGCTGTAGTTCAGTTAATAGGTAATACCCCTATAGTT
TAGTCAGGAGAAGAACTTATCCGATTTCTGATCTCCATTTTTAATTATATGAAATGAACTGTAGCATA
AGCAGTATTCATTTGGATTATTTTTTTATTAGCTCTCACCCCTTCATTATTCTGAGCTGAAAGTCTG
GCATGAACTGTCCTCAATTTTGTTTTCAAATTCACATCGATTATCTATGCATTATCCTCTTGTATCTA
CCTGTAGAAGTTTCTTTTTGGTTATTCCTTGACTGCTTGATTACAGAAAGAAATTTATGAAGCTGTAA
TCGGGATAGTTATACTGCTTGTTCTTATGATTCATTTCCTTTGTGCAGTTCTTGGTGTAGCTTGCCAC
TTTCACCAGCAAAGTTC

SEQ ID NO: 407 - DNA - expression cassette
AATCCGAAAAGTTTCTGCACCGTTTTCACCCCCTAACTAACAATATAGGGAACGTGTGCTAAATATAA
AATGAGACCTTATATATGTAGCGCTGATAACTAGAACTATGCAAGAAAAACTCATCCACCTACTTTAG
TGGCAATCGGGCTAAATAAAAAGAGTCGCTACACTAGTTTCGTTTTCCTTAGTAATTAAGTGGGAAA
ATGAAATCATTATTGCTTAGAATATACGTTCACATCTCTGTCATGAAGTTAAATTATTCGAGGTAGCC
ATAATTGTCATCAAACTCTTCTTGAATAAAAAAATCTTTCTAGCTGAACTCAATGGGTAAAGAGAGAG
ATTTTTTTAAAAAAATAGAATGAAGATATTCTGAACGTATTGGCAAAGATTTAAACATATAATTATA
TAATTTTATAGTTTGTGCATTCGTCATATCGCACATCATTAAGGACATGTCTTACTCCATCCCAATTT
TTATTTAGTAATTAAAGACAATTGACTTATTTTTATTATTTATCTTTTTTCGATTAGATGCAAGGTAC
TTACGCACACACTTTGTGCTCATGTGCATGTGTGAGTGCACCTCCTCAATACACGTTCAACTAGCAAC
ACATCTCTAATATCACTCGCCTATTTAATACATTTAGGTAGCAATATCTGAATTCAAGCACTCCACCA
TCACCAGACCACTTTTAATAATATCTAAAATACAAAAAATAATTTTACAGAATAGCATGAAAAGTATG
AAACGAACTATTTAGGTTTTTCACATACAAAAAAAAAAAGAATTTTGCTCGTGCGCGAGCGCCAATCT
CCCATATTGGGCACACAGGCAACAACAGAGTGGCTGCCCACAGAACAACCCACAAAAAACGATGATCT
AACGGAGGACAGCAAGTCCGCAACAACCTTTTAACAGCAGGCTTTGCGGCCAGGAGAGAGGAGGAGAG
GCAAAGAAAACCAAGCATCCTCCTCCTCCCATCTATAAATTCCTCCCCCCTTTTCCCCTCTCTATATA
GGAGGCATCCAAGCCAAGAAGAGGGAGAGCACCAAGGACACGCGACTAGCAGAAGCCGAGCGACCGCC
TTCTTCGATCCATATCTTCCGGTCGAGTTCTTGGTCGATCTCTTCCCTCCTCCACCTCCTCCTCACAG
GGTATGTGCCCTTCGGTTGTTCTTGGATTTATTGTTCTAGGTTGTGTAGTACGGGCGTTGATGTTAGG
AAAGGGGATCTGTATCTGTGATGATTCCTGTTCTTGGATTTGGGATAGAGGGGTTCTTGATGTTGCAT
GTTATCGGTTCGGTTTGATTAGTAGTATGGTTTTCAATCGTCTGGAGAGCTCTATGGAAATGAAATGG
TTTAGGGTACGGAATCTTGCGATTTTGTGAGTACCTTTTGTTTGAGGTAAAATCAGAGCACCGGTGAT
TTTGCTTGGTGTAATAAAAGTACGGTTGTTTGGTCCTCGATTCGGTAGTGATGCTTCTCGATTTGAC
GAAGCTATCCTTTGTTTATTCCCTATTGAACAAAAATAATCCAACTTTGAAGACGGTCCCGTTGATGA
GATTGAATGATTGATTCTTAAGCCTGTCCAAAATTTCGCAGCTGGCTTGTTTAGATACAGTAGTCCCC
ATCACGAAATTCATGGAAACAGTTATAATCCTCAGGAACAGGGGATTCCCTGTTCTTCCGATTTGCTT
TAGTCCCAGAATTTTTTTTCCCAAATATCTTAAAAAGTCACTTTCTGGTTCAGTTCAATGAATTGATT
GCTACAAATAATGCTTTTATAGCGTTATCCTAGCTGTAGTTCAGTTAATAGGTAATACCCCTATAGTT
TAGTCAGGAGAAGAACTTATCCGATTTCTGATCTCCATTTTTAATTATATGAAATGAACTGTAGCATA
AGCAGTATTCATTTGGATTATTTTTTTATTAGCTCTCACCCCTTCATTATTCTGAGCTGAAAGTCTG
GCATGAACTGTCCTCAATTTTGTTTTCAAATTCACATCGATTATCTATGCATTATCCTCTTGTATCTA
CCTGTAGAAGTTTCTTTTTGGTTATTCCTTGACTGCTTGATTACAGAAAGAAATTTATGAAGCTGTAA
TCGGGATAGTTATACTGCTTGTTCTTATGATTCATTTCCTTTGTGCAGTTCTTGGTGTAGCTTGCCAC
TTTCACCAGCAAAGTTCATTTAAATCAACTAGGGATATCACAAGTTTGTACAAAAAAGCAGGCTTAAA
CAATGGATGATCACATGGGAAGACGGACAGTTGGTGGCCTTCTCTTCACCAAGGGGGGCTCAATTCTT
```

FIGURE 19 (continued)

```
CTCTTCAGAGAAGACAGTGCGCGTCACAAGGCCACCAATTGCTGCACGCGACACGGTTGCAGCAGCAA
GCATTTGGCCGGCAAAGACAAGCAAACACACAGGGCAGCAACAGCAGCCAAGGAAGCATCAGAAACCC
CTCGGAGATCACAGATTTTCAGGAAACCCAGCACGAGGACTCCTCAGGGAAGTACTGCTACTGATAAC
ATCAGCAGGAATGCAGCAAGCTCCTATAGCGAAAACGACAATAGGCCAAGAGAAACTCCAGGGCGTGA
TTTAATCGCTCGTCTCAAAGAGAGGGTCAATGCATCAAGAAAACGATCATTGAACAGAGAAAACAGTC
CATCATCACCAAATGGATTAAGTGCTACTTCCTCAAGTAGTAGCCGCACAGTCTCAAGACCGTCGCAT
CGGGCAGCTTCCCGAATAAGGAAGGCAGATGAAGGTGCAAATGCAGGAGCTGTAAATGTACGCAGAGA
CAGCAGTGGAGATACCAGGAGGAATTCAGATAGGATGTCGATGATTTCTTGCTAGTTGAGCAGGCAG
CAAGAGATAGCACTGAAGGATTCATATCTGGATTCTTGGCAAGATACAGAAGTAATCATCAGGGACTA
CTTTCATCTTTGGACGACAGCATAGAGGATGCAAATGGGTACTGGCGCTTCAATATGGAAGGAAGTGA
AGAGCTTGAGAACTACTTCATATTCAATGATCGGTACAGAGGGATGAGAATGGACATTGACGGCATGT
CTTATGAGGAATTGCTAGCATTGGGAGATAGAATTGGCACCGTAAGCACTGGCCTTTCAGAAGACGCG
CTGTCCAAGTGTCTAGACAGAAGCATGTACATGGCCACTACTTCAGGAACTCATGAAGATTGTGAGAG
AAAATGCAGCATATGCCAGGAGGAATATTCAGATGGTGAGGAGGTGGGCAAGATGGTCTGCAAACATT
ACTACCACTTCTCCTGCATAAAGAACTGGCTCCGGCAGAAGAACTGGTGTCCCATTTGTAAATCCGTC
GCTCTGAATACCAACTAG
```

FIGURE 19 (continued)

mdta`sfvtslltsfvifvvlvlvftw`lssrpgnapvyypsvllrgldpwegrgrt
rspvgwlrqaisasegdvvavggvdaavy`lvflssvlsilvfsgivllpvll`pvaa
tddnlnleraiglkngktpqnfteleklalgnvqehsrr`lwafllsvywvsfvtyf
vlw`ksykhvsnmraaarstpdvkpeefavlvrdvpkpppdqtikdsvdsyfralhp
dtfyrsmvvtdhtkadkiyqeieghkqkiaraevvyaeskttgkpegtkpthrigf
lgligkkvdtieycndqikellpkleaeqkttlrekqqqaaivffnrrsaaasasq
tlhaqmfdkwtveqapeprqiiwsnpskkiyerqirq`vvvytivfltvvfymipit`
`aisa`lttleklreklpflkvvvdqpkiktvlqaylp

FIGURE 20

```
                          1                                              50
AT1G10090     (1)  ---------------------------------------MDVSALLTSAGINI
AT1G58520     (1)  --------------------------------------------------
Os03g0673800  (1)  ---------------------------------------MKVGALLTSAGINI
Os12g0633600  (1)  ---------------------------------------MKISGLLTSAGINI
Os03g0726300  (1)  ---------------------------------------MEFSALLTSAGINI
AT1G69450     (1)  ---------------------------------------MLLSALLMSVGINS
Os12g0582800  (1)  ---------------------------------------MILSALATSVGINL
AT3G01100     (1)  ---------------------------------------MLLSALLTSVGINL
AT3G54510     (1)  --------------------------------------------------
Os01g0950900  (1)  --------------------------------------MDAEGLLASAAINL
AT1G30360     (1)  ---------------------------------------MEFGSFLVSLGTSF
Os07g0150100  (1)  ---------------------------------------MDTASFVTSLLTSF
YTP1          (1)  ---------------------------------------MDTASFVTSLLTSF
AT4G35870     (1)  MNRNFSPAAMPPISSMTIDNSFSPPPSSGDLPEIPDAWYGNIQYLLNISV
Os03g0137400  (1)  ------------------MGPTAPPPDAGGG--EPEAWYGSIQYLVNISA
AT4G02900     (1)  ---------------------------------------MATLQDIGVSALINL
Os10g0579100  (1)  ---------------------------------------MATLPDLGVSAFINI
Os05g0393800  (1)  ---------------------------------------MGSLTDIGVAAGINI
AT3G21620     (1)  ---------------------------------------MATLTDIGVAATINI
AT4G15430     (1)  ---------------------------------------MATINDIGVAAAINI
AT1G11960     (1)  ---------------------------------------MATLGDIGVAAAINI
AT1G62320     (1)  ---------------------------------------MATLADIGLAAAINI
AT4G04340     (1)  ---------------------------------------MATLKDIGVSAGINI
AT4G22120     (1)  ---------------------------------------MATLQDIGVSAGINI
Os01g0534900  (1)  ---------------------------------------MATIQDIGVSAAINI
Os05g0594700  (1)  ---------------------------------------MATVSDIGLSAAINV
Consensus     (1)                                           A L  I VSAGINI 51                                             100
AT1G10090    (15)  AICVVLVSLYSILRKQPANYCVYFGRLLSDGRV-----------KRHDPR
AT1G58520     (1)  --------------------------------------------------
Os03g0673800 (15)  SLCILFLSLYSVLRKQPQNVKVYFGRRIAEENS-----------RLREAF
Os12g0633600 (15)  ALSVLFISLYSVLRKQPANVRVYFGRRIAEEHN-----------RLREAF
Os03g0726300 (15)  GLCALFLSLYSVLRKQPHNYGVYFGRRLAEEKFR----------QQVDYF
AT1G69450    (15)  CLCVLLFILYSVLRKQPRNYEVFLPRRLANGTYK----------RRRN--
Os12g0582800 (15)  GLTVLLAAAYTLLRRPPPYVAVYSPR-----RP-----------------
AT3G01100    (15)  GLCFLFFTLYSILRKQPSNVTVYGPRLVKKDGKS----------QQSNEF
AT3G54510     (1)  --------------------------------------------------
Os01g0950900 (15)  GLALVALSLFSLLKKQPGNAPVYLARRMAAGGG-----------GGGLPL
AT1G30360    (15)  VIFVILMLLFTWLSRKSGNAPIYYPNRILKGLEPWEGTS-----------
Os07g0150100 (15)  VIFVVLVLVFTWLSSKPGNAPVYYPSVLLRGLDPWEGRGR----------
YTP1         (15)  VIFVVLVLVFTWLSSPPGNAPVYYPSVLLRGLDPWEGRGR----------
AT4G35870    (51)  IGLLCCVSIFLFVKLRSDHRRMPGPS------------------------
Os03g0137400 (31)  VGAASCVLLFLLVKLRFDHRRIPGPS------------------------
AT4G02900    (16)  FGAFLFLIAFAVLRIQPINDRVYFPKWYLTGERNSPRRSDRTLVGKFVNL
Os10g0579100 (16)  LGAFVFLLIFAALRLQPINDRVYFPKLYLTGQRR-----HHPHPHGFVNL
Os05g0393800 (16)  LSALGFLLAFAVLRIQPINDRVYFPKWYLKGTRSSPR-SMGTVFSKFVNA
AT3G21620    (16)  LTAFAFFIAFAILRLQPVNDRVYFPKWYLKGLRSSPI-KTGGFASKFVNL
AT4G15430    (16)  VTAFAFLLAFAIFRIQPVNDRVYFPKWYLKGLRSSSI-QTGGFGSKFINL
AT1G11960    (16)  LTAIIFLLAFAILRIQPFNDRVYFPKWYLKGIRSSPL-HSGALVSKFVNV
AT1G62320    (16)  LSALIFLLLFAILRIQPFNDRVYFPKWYLKGVRSSPV-NSGAFVSKIMNL
AT4G04340    (16)  LTAFIFFIIFAFLRLQPFNDRVYFSKWYLRGLRSSPA-SGGGFAGRFVNL
AT4G22120    (16)  LSAFVFFIIFAVLRLQPFNDRVYFSKWYLKGLRSSPA-RGGAFAQRFVNL
Os01g0534900 (16)  LSAITFLLAFAFLRLQPINDRVYFPKWYLKGARESPS-HGGAFVRKFVNL
Os05g0594700 (16)  SMAVAFLLVFAFLRLQPINDRVYFPKWYLRGMRDSPV-SSGAAVQKVVNL
Consensus    (51)  L AVLFLLLFAVLRLQP N RVYFPK  LKG
```

FIGURE 22

```
                 101                                             150
   AT1G10090 (54) WYERFAPSPSWLVKAWETTEEEMLAAAGLDAVVFIRMVICSIRIFSIVAV
   AT1G58520  (1) -------------------------------MVIFSIRIFFIVAV
 Os03g0673800 (54) ILERFVPSASWILRSLRCTEDELLATAGLDAVVFNRILVFSIRIFSLAAF
 Os12g0633600 (54) ILERFVPSTGWIVKALQCTEEEILAAAGLDAVVFNRILVFSLRIFSLAAI
 Os03g0726300 (55) SLERLLPTAGWIVKAYWCTEEEIRRVAGLDSVVFLRLFIFSIRIFSITSL
   AT1G69450 (53) KVARYIPSLKWIWKSWRPTEKELMESSGLDVVFMRMITFSLKVFLFAGI
 Os12g0582800 (43) ----YAPPEPWLPAAWRRTEADVHAAAGLDGVVFLRIFVFSIRVFAAAAV
   AT3G01100 (55) NLERLLPTAGWVKRALEPTNDEILSNLGLDALVFIRVFVFSIRVFSFASV
   AT3G54510  (1) ----------------------------------MCRIRFFLMCSL
 Os01g0950900 (54) GHGRLTPSFRWIRAALRLSEDDVLRPHGLDALVVVRLFKFGIKCFAVCSI
   AT1G30360 (54) ---LTRNPFAWMREALTSSEQDVVNLSGVDTAVHFVFLSTVLGIFACSSL
 Os07g0150100 (55) ---GTRSPVGWLRQAISASEGDVVAAGGVDAAVYLVFLSSVLSILVFSGI
        YTP1 (55) ---GTRSPVGWLRQAISASEGDVVAVGGVDAAVYLVFLSSVLSILVFSGI
   AT4G35870 (77) ------ALFSKLLAVWKATCREIARHCGADAAQFLLIEGGSFVLLFSIAV
 Os03g0137400 (57) ------ALAAKLLAVYRATAPQIALHCGADAAQFLLFERASFLVLAAVAA
   AT4G02900 (66) NYKTYFTFLNWMPQAMKMSESEIIRHAGLDSAIFLRIYTLGLKIFAPVMV
 Os10g0579100 (61) DLCSYLRFLAWVPGALRMSQPDLIHHAGLDSAVYLRIYTLGLKIFLPIMF
 Os05g0393800 (65) DLSTYIRFLNWMPAALQMPEPELIEHAGLDSAVYVRIYLLGLKIFVPIAV
   AT3G21620 (65) DFRSYIRFLNWMPQALRMPEPELIDHAGLDSVVYLRIYLLGLKIFFPIAC
   AT4G15430 (65) DFRSYIRFLNWMPEALKMPEPELVDHAGLDSVVYLRIYLLGLKIFFPIAC
   AT1G11960 (65) NLGSYLRFLNWMPAALKMPEPELIDHAGLDSAVYLRIYLIGLKIFVPIAL
   AT1G62320 (65) DFRSYVRFLNWMPDALKMPEPELIDHAGLDSAVYLRIYLIGLKIFGPIAL
   AT4G04340 (65) ELRSYLKFLHWMPEALKMPERELIDHAGLDSVVYLRIYWLGLKIFAPIAM
   AT4G22120 (65) DFRSYMKFLNWMPEALKMPEPELIDHAGLDSVVYLRIYWLGLKIFTPIAV
 Os01g0534900 (65) DMRSYLKVLSWMPAALKMPEDELISHAGLDSAVYLRIYLIGLKIFAPITV
 Os05g0594700 (65) NMRSYLKFLSWMPAALKMPEDELINHAGLDSAVYLRIYLTGIKIFVPISI
    Consensus (101)       YL  L WM  ALK TE ELI HAGLDS VYLRIYL  LKIF  IAV 151                                             200
   AT1G10090 (104) VCLAFVLPVNYYG---------QKMEHKEVHLESLGVFTIENLNPRSRW
   AT1G58520 (15) ICIAFVLPVNYYG---------QPMVHKEIHLESSEVFTIENLKEGSKW
 Os03g0673800 (104) LCVLGVLPLNYFG---------QDMLHVRIPSASLETFTIGNMQERSRW
 Os12g0633600 (104) LCVFGILPLNYFG---------QDIHHVRIPSESLDIFTIGNVKVRSRW
 Os03g0726300 (105) VCIFGVLPVNYHG---------KETNHGRIPAESLNVFTIANLKEGSRM
   AT1G69450 (103) IGVFVLLPVNCFGD------QL-TVIDYADWSANSLDLFSVANLKVRSQW
 Os12g0582800 (89) VGVGVLMFVNFMGD------QL-RQIDFSDLPNKSVDLFSVSNVQDGSNK
   AT3G01100 (105) VGIFILLPVNYMG--------T-EFEEFFDLPKKSMDNFSISNVNDGSNK
   AT3G54510 (13) LGASLLLPVDYYN----------ESDLPTRREYSMDAFTISNITRGSNK
 Os01g0950900 (104) VGLFILAPTNYSC----------EGLQDTKRSNSMELFTVSNVARGSNR
   AT1G30360 (101) LLLPTLLPLAATDN--NIKNTKNATDTTSKGTFSQLDNLSMANITKKSSR
 Os07g0150100 (102) VLLPVLLPVAATDDNLNLERAIGLKNGKTPQNFTELEKLALGNVQEHSRR
        YTP1 (102) VLLPVLLPVAATDDNLNLERAIGLKNGKTPQNFTELEKLALGNVQEHSRR
   AT4G35870 (121) LAVSVMLPLNLYAG-------------TALLSDELSKTMITRIQKGSAL
 Os03g0137400 (101) AAVAAALPLNLLAG--------------DAAIADQFAATTISHIPKSSPL
   AT4G02900 (116) LALVVLPVNVSSG------TLFFLK--KELVVSNIDKLSISNVQPKSSK
 Os10g0579100 (111) VALLVLIPVNVSGG------TLLNLR--KEIVFSDIDKLSISNVNPGSNR
 Os05g0393800 (115) LAFIVLVPINWASG------TLEKEK---SLSYDQIDKLSISNLGKGSKR
   AT3G21620 (115) IAFTVMPVNWTNS------TLDQLKN---LTFSDIDKLSISNIPTGSSR
   AT4G15430 (115) VAFTTMVPVNWTNK------GLDRLHSN-ISFSDIDKLSLSNIPNGSPR
   AT1G11960 (115) LAWSILVPVNWTSH------GLQLAK-LRNVTSSDIDKLSISNIENGSDR
   AT1G62320 (115) LSWSILVPVNWTSD------GLQLAK-LRNVTSSNIDKLSISNVERGSDR
   AT4G04340 (115) LAWAVLVPVNWTNN------ELELAKHFKNVTSSDIDKLTISNIPEGSNR
   AT4G22120 (115) LAWAVLVPVNWTNN------TLEMAKQLRNVTSSDIDKLSVSNIPEYSMR
 Os01g0534900 (115) LAFIILVPVNWTNI------TLQSSK----VQHSDIDKLSISNIPVGSKR
 Os05g0594700 (115) LASLVLFPVNWTND------TLDSMK----VVHSKIDKLSISNIPYGSNR
    Consensus (151) LAL VLLPVNWT         L       V  S IDKLSISNI GS R
```

FIGURE 22 (continued)

```
                   201                                              250
AT1G10090   (144) LWVHCLSLYIISSAACALLYFEYKNIAKKRLAHISGSASKPSH-----FT
AT1G58520    (55) LWVHCLALYIITSAACLLLYFEYSTIAKMRLGHITGCASKPSQ-----FT
Os03g0673800 (144) LWVHCVALYIISGVACLLLYEYKHIARLRLLHVSRASTNPSH-----FT
Os12g0633600 (144) LWVHCVALYIISGVACILLYEYKHIARLRLRHLTCAMPNPSH-----FT
Os03g0726300 (145) LWVHCVALYVITISACILLYYEYKYISRKRLAHITGSPPGPGH-----FS
AT1G69450   (146) LWVHFGAIYLVTVFVCCLLYFEFRYIALKRIEHFYSSKPKPEQ-----FT
Os12g0582800 (132) LWLHFSAVYIITGITCYLLYYEYKYISGKRLEYFMTSKPLPQH-----FT
AT3G01100   (146) LWIHFCAIYIFTAVVCSLLYYEHKYILTKRIAHLYSSKPQPQE-----FT
AT3G54510    (52) LWVHFSCLWCISFYALFLLHKEYKEILVIRLQQMKELRHRADQ-----FT
Os01g0950900 (143) LWVHFACLCFISFYVVYLLHKEHKEMSSRRIAHLKYHRKRPDQ-----YT
AT1G30360   (149) LWAFLGAVYWISLVTYFFLWKAYKHVSSLRAQALMSADVKPEQ-----FA
Os07g0150100 (152) LWAFLLSVYWVSFVTYFVLWKSYKHVSNMRAAARSTPDVKPEE-----FA
YTP1        (152) LWAFLLSVYWVSFVTYFVLWKSYKHVSNMRAAARSTPDVKPEE-----FA
AT4G35870   (157) LWLHFVFVVIVVVISHFGIAAIEARLKFTRFRDGNGNISDPNANSTAVFT
Os03g0137400 (137) LWLHLLLLTAAVVAIAHLGISRMEDALRITRFRDGNGNPSDPNSSSVAVFT
AT4G02900   (158) FFFHIAVEYIFTFWACFMLYREYNNVAIMRLQYLASQRRRPEQ-----FT
Os10g0579100 (153) FFIHLLMAYVFTFWTCFMLYKEYSNVAFMRLHFLASQKRCADQ-----FT
Os05g0393800 (156) FWAHIVMAYVFTFWTFFVLYREYKVVTMRLRFLAIQNRRADQ-----FT
AT3G21620   (156) FWVHLCMAYVITFWTCFVLQREYKHIASMRLQFLASEHRRPDQ-----FT
AT4G15430   (158) FWVHLCMAYAITFWTCFILKREYQNIALMRLQFLANDQRRPHQ-----FT
AT1G11960   (158) FWTHLVMAYAFTFWTCYVLMKEYEKVAAMRLAFLQNEQRRPDQ-----FT
AT1G62320   (158) FWAHLVMAYAFTFWTCYVLMKEYEKIAAMRLSFLQSEKRRADQ-----FT
AT4G04340   (159) FWAHIIMAYAFTIWTCYMLMKEYETVANMRLQFLASEGRRPDQ-----FT
AT4G22120   (159) FWTHIVMAYAFTIWTCYVLMKEYETIANMRLQFVASEARRPDQ-----FT
Os01g0534900 (155) FAAHLTMAYVFTFWTCYVLLREYEIVATMRLRFLASEKRRPDQ-----FT
Os05g0594700 (155) FVTHLVMAYAVTFWTCYVLFREYEIITTMRLRFLASEKRRPDQ-----FT
Consensus   (201) LWVHLV LYIITFWTCFLLYKEYK IA MRL  LAS  RPDQ     FT 251                                              300
AT1G10090   (189) VLIRAIPQSPDQ-SYSETVSKYFTNYYAPSYVSHLMVYRDGFIHRLMNET
AT1G58520   (100) VLIRAIPWSPEQ-SYSDTLSKFFTNYYSSSYVSHQMVYHNGIIQRLLRDA
Os03g0673800 (189) VLVRGVPKSTKE-SISCTVESFFTKYHVSSYLSHQIIYKVGKLQKIVTGA
Os12g0633600 (189) VLVRGIPKETKE-SCSNAIDDFFTKYHGSSYLFHQVVYKVGKVQKIMTGA
Os03g0726300 (190) VIVRSIPKSDNE-LLDDTIPNFFVNYHGSSYLSHQMIYRKGSMQKFVDNA
AT1G69450   (191) ILVRNIPSSDGS-SVSDTVDRFFGENHSSTYFSHVVIHRTSKLRSVVDKA
Os12g0582800 (177) VLVRAIPVTNGV-SVSDAVDKFFKEYHSGTYLSHTVVHQTGKLRRLLNDA
AT3G01100   (191) VLVSGVPLVSGN-SISETVENFFREYHSSSYLSHIVVHRTDKLKVLMNDA
AT3G54510    (97) VLVRQVPLCFEHNTRGCAVDHFFSKHHRFSYHSHQMLYDGRDLEYLLGKQ
Os01g0950900 (188) ILVRGIPLCPDHGTYGCYADHFFSKHYRT-YQSYHIVHDIGNIKALQKLA
AT1G30360   (194) ILVRDMPAPPDGQTQKEFIDSYFREIYPETFYRSLVATENSKVNKIWEKL
Os07g0150100 (197) VLVRDVPKPPPDQTIKDSVDSYFRALHPDTFYRSMVVTDHTKADKIYQEI
YTP1        (197) VLVRDVPKPPPDQTIKDSVDSYFRALHPDTFYRSMVVTDHTKADKIYQEI
AT4G35870   (207) IMVQGLPKNLGS--DRVEFEDCFRLKYPGKVYKFIVPMDLCALDDLATEL
Os03g0137400 (187) IMIQGIPKTLAA--DKTPLKDYFEHKYPGKVYRVIVPFDLCTLEYLAEEW
AT4G02900   (203) VVVRNVPDMPGH-SVPDTVDQFFKTNHPEHYLCHQAVYNANTYAKLVKQR
Os10g0579100 (198) VIVRNIPHVSSH-STSETVDEFFRRNHPDHYLGQQAVYNANRYAKLVKKK
Os05g0393800 (201) VLVRNVPDPDE-TVSEHVEHFFAVNHRDHYLSHQTVYNANTLAGLVEQK
AT3G21620   (201) VLVRNIPPDPDE-SVSELVEHFFKVNHPDYYLTQAVYNANKLSELVQKR
AT4G15430   (203) VLVRNIPADPHE-SICELVEHFFKVNHPDHYLTFQAVHDATKLSELVLTR
AT1G11960   (203) VLVRNVPADPDE-SISDSVEHFFLVNHPDHYLTHQVVYNANDLAALVEQK
AT1G62320   (203) VLVRNVPPDSDE-SISENVQHFFLVNHPDHYLTHQVVYNANELAKLVEDK
AT4G04340   (204) VLVRNVPDPDE-TVSELVEHFFLVNHPDNYLTHQVVCNANKLADLVSKK
AT4G22120   (204) VLVRNVPDADE-SVSELVEHFFLVNHPDHYLTHQVVCNANKLADLVKKK
Os01g0534900 (200) VLVRNIPPDPDE-SIGELVEHFFLVNHPDHYLTHQVVYNANKLDKMVKEK
Os05g0594700 (200) VLVRNIPPDPDE-SISELVEHFFLVNHPDHYLRHQVVYNANKLADLVEKK
Consensus   (251) VLVRNIP  PDE SISE VE FF   HPD YLSHQVVY  KL KLV
```

FIGURE 22 (continued)

```
                      301                                                350
AT1G10090    (238) ERMCQAIKHVSPDLS---C-------NPSLKSCVLCG--------PAATN
AT1G58520    (149) ERMCQTLKHVSPEIN---C-------KPSLRPCTFCG-------GPTATS
Os03g0673800 (238) KKAYRKFKHFKGTTVDQRC-------GPITYRCGLCG--------ASSK
Os12g0633600 (238) KKAYRKFKHFTDSTIDQRC-------RAISYRCCLCG--------ASSN
Os03g0726300 (239) ERVYRKFVRVKMSSFGQSR-------RSDLSRCGLCG--------VRAS
AT1G69450    (240) KKLYKEVKHKKP--VK---------KTPMR-----------FFSRKD
Os12g0582800 (226) ENICTKLANLKS--VR---------RTSGDPPGKFL-------GIFGRN
AT3G01100    (240) EKLYKKLTRVKSGSIS---------RQKSRWGGFLG-------MFGNNV
AT3G54510    (147) KKLKKELEDKRH------T-------EILSNG------------SQEH
Os01g0950900 (237) SSLEDKIKPKRE------T-------RRCNFWKWIWF-------KLTLEA
AT1G30360    (244) EGYKKKLARAEAILAATNNR--------PTNKTGFCG-------LVGKQV
Os07g0150100 (247) EGHKQKIARAEVVYAESKTTGKPE-GTKPTHRIGFLG-------LIGKKV
YTP1         (247) EGHKQKIARAEVVYAESKTTGKPE-GTKPTHRIGFLG-------LIGKKV
AT4G35870    (255) VRVRDEITWLVAKMDSRLLPDEYENVGDNGLVFCVCSLWVRVKVLWSQIT
Os03g0137400 (235) GKVRNRISWLEARMDAPNLFDEFAQGGRHSEEHWIVR---RCKELWVMTA
AT4G02900    (252) AKLQRWFDYYVLKHQRNPH-------KQPTCRTGFLG-------LWGKRV
Os10g0579100 (247) ERLQNWLDYYQLKFERHPG-------KRPIGRTGCLG-------FCGREV
Os05g0393800 (250) KGLQNWLVYYENQHAKNPA-------KKPTMKTGLWG-------LWGKRV
AT3G21620    (250) MKLQNWLDYYQNKHSRNPS-------KRPLIKIGFLG-------CWGEEV
AT4G15430    (252) KQMQNLLDYNINKHMRNLS-------NRPVIKMGFLG-------CCGEEA
AT1G11960    (252) KSTQNWLDYYQLKYTRNQE-------HKPRIKTGFLG-------LWGKKV
AT1G62320    (252) KKMQNWLDYYQLKYTRNKE-------QRP--RMGFLG-------LWGKKV
AT4G04340    (253) TKLQNWLDYYQLKYTRNNSQ------IRPITKLGCLG-------LCGQKV
AT4G22120    (253) KKLQNWLDYYQLKYARNNS-------QRIMVKLGFLG-------LWGQKV
Os01g0534900 (249) KKMQNWLDYYQLKYERNTS-------QRPTKTGFLG-------CFGSKV
Os05g0594700 (249) KKLQNWLDYYQLKYERNPS-------KRPTKTGFLG-------CFGSEV
Consensus    (301)      KL N L Y      RN           RP K GFLG            G  V 351                                                400
AT1G10090    (270) SFQIISNETDSVKG-LELGELTLTTTEEE------RPVAFVFFKSRYDAL
AT1G58520    (182) SFHILSNEADSVKG-MELGELTMTTTTTEQE----RSAAFVFFKTRYDAL
Os03g0673800 (272) SFELLPVEPEQEM--KKHDVKDSELSLPDKD----CGAAFVFFKTRYAAL
Os12g0633600 (272) SFQLLATGLEQNQ--GKSDLQDSSLKLDDQE----CAAAFVYFRTRYAAL
Os03g0726300 (273) SFQQYRNKFINS---KKPDLSDPEVIEAQKD----CPGAIVFFKTRYAAI
AT1G69450    (265) NTEGHYESVLQEME-QNIRLGQAEVSAPGKE----VRAAFVSFKSRYGAA
Os12g0582800 (257) DLVGKYQKRLEDLE-ENVRMEQSDTTRSRQE----VPAAFVSFRSRYGAA
AT3G01100    (273) DVVDHYQKKLDKLE-DDMRLKQSLLAG--EE----VPAAFVSFRTRHGAA
AT3G54510    (170) KQISTSEEKLREIT-HMIYHLQSETMLREKE----LPVAFVTFKSRRNAA
Os01g0950900 (267) IDTRKLEEKLKNVH-HSIRLLQCENMLKRKE----LPVAFVSFKSQLDAA
AT1G30360    (279) DSIEYYTELINESVAKLETEQKAVLAEKQQ------TAAVVFFTTRVAAA
Os07g0150100 (289) DTIEYCNDQIKELLPKLEAEQKTTLREKQQ------QAAIVFFNRRSAAA
YTP1         (289) DTIEYCNDQIKELLPKLEAEQKTTLREKQQ------QAAIVFFNRRSAAA
AT4G35870    (305) ERFGFTDDEKLRKLQELRADLESQLAAYKEGRAQGAVAFVMFKDVYTAN
Os03g0137400 (282) ERFGFTDEEMLRRLQTKKLVLGSRLSDYKDGRAPGAGIAFVVFKDVYTAN
AT4G02900    (288) DSIEYYKQQIKEFDHNMSLERQKVLKDSKLM----LPVAFVSFDSRWGAA
Os10g0579100 (283) DQIDYYRARISELDKKLASERQRVLNDPKAV----MPVAFVTFDSRWGAA
Os05g0393800 (286) DAIEHYTTAIEELCKQEDEERHKVITDPNAI----MPAAFVSFKSRWGAA
AT3G21620    (286) DAIDHYIEKIEGLTRKISEEKETVMSSTKSL----VPAAFVSFKKRWGAV
AT4G15430    (288) DGIKYYTSVVEGLTREISEEKQRLRTGTKSI----VPAAFVSFKSRWGAA
AT1G11960    (288) DAIDHYIAEIEKLNEQIMEERKKVKKDDTSV----MPAAFVSFKTRWGAA
AT1G62320    (286) DAMDHYTAEIEKLSEQIMEERKRIKKDDKSV----MQAAFVSFKTRWGAA
AT4G04340    (290) DAIEHYIAEVDKTSKEIAEERENVVNDQKSV----MPASFVSFKTRWAAA
AT4G22120    (289) DAIEHYIAEIDKISKEISKEREEVVNDPKAI----MPAAFVSFKTRWAAA
Os01g0534900 (285) DAIEYYTSEIERIEKEETDERGKIMKDPKSV----VPAAFVSFRSRWGAA
Os05g0594700 (285) DAIEYYKAEIEKIGKEEADERQKIMKDPQSA----VPAAFVSFRSRWGAA
Consensus    (351) D IEYY    I  L   I  ER  VL D          VPAAFVSFKSRWGAA
```

FIGURE 22 (continued)

```
                        401                                              450
    AT1G10090   (313)   VVSEVLQTPNP---------------MLWVADLAPEPHDVHWRNLRIP
    AT1G58520   (227)   VVSEVLQSSNP---------------MLWVTDLAPEPHDVYWKNLNIP
  Os03g0673800  (316)   VVSEIVQTSNP---------------MEWVTSLAPDRHDVYWSNLWLP
  Os12g0633600  (316)   VASEILQTSNP---------------MKWVTDLAPEPDDVYWSNLWLP
  Os03g0726300  (316)   VASEILQSSNP---------------MLWVTDFAPEPRDVYWSNLWIP
    AT1G69450   (310)   TALHMPQSINP---------------TYWLTEPAPEPHDVHWPFFSAS
  Os12g0582800  (302)   NAIYIRQSDKP---------------TEWQTEHAPDPHDVYWPFFSTS
    AT3G01100   (316)   IATNIQQGIDP---------------TQWLTEAAPEPRDVHWPFFTAS
    AT3G54510   (215)   LAAQTQQHSNP---------------LELITEMAPEPRDVSWRNLAIP
  Os01g0950900  (312)   QAAEMQQHVNP---------------LSLVTTYAPEPPDALWTNLAIP
    AT1G30360   (323)   SAAQSLHCQMV---------------DKWTVTEAPEPRQLLWQNLNIK
  Os07g0150100  (333)   SASQTLHAQMF---------------DKWTVEQAPEPRQIIWSNLSKK
         YTP1   (333)   SASQTLHAQMF---------------DKWTVEQAPEPRQIIWSNLSKK
    AT4G35870   (355)   KAVQDFRNEKS-RRTGKFFSVTELRLQRNQWKVDRAPLATDIYWNHLGLT
  Os03g0137400  (332)   KAVRDFRMEPKKTPIGRFFPVMELQLERSRWTVERAPPASDIYWNHLGLS
    AT4G02900   (334)   VCAQTQQSKNP---------------TLWLTSSAPEPRDIYWQNLAIP
  Os10g0579100  (329)   VCAQTQQSKNP---------------TQWLTDWAPEPRDVYWQNLAIP
  Os05g0393800  (332)   VCAQTQQTSNP---------------TLWLTEWAPEPRDVFWPNLAIP
    AT3G21620   (332)   VCSQTQQSRNP---------------TEWLTEWAPEPRDIYWDNLALP
    AT4G15430   (334)   VCAQTQQTRNP---------------TEWLTEWAAEPRDIYYDNLALP
    AT1G11960   (334)   VSAQTQQSSDP---------------TEWLTEWAPEAREVFWSNLAIP
    AT1G62320   (332)   VCAQTQQTKNP---------------TEWLTEWAPEAREMYWPNLAMP
    AT4G04340   (336)   VCAQTTQTRNP---------------TEWLTEWAAEPRDIYWPNLAIP
    AT4G22120   (335)   VCAQTQQTRNP---------------TQWLTEWAPEPRDVFWSNLAIP
  Os01g0534900  (331)   VCAQTQQTSNP---------------TVWLTEWAPEPRDVYWDNLSIP
  Os05g0594700  (331)   VCAQTQQTSNP---------------TVWITEWAPEPRDVYWNNLSIP
    Consensus   (401)   VAAQTQQT NP                T WLTE APEPRDVYW NLAIP 451                                              500
    AT1G10090   (346)   YRQLWMRRIATLVGAIAFMFVFLFPVTFVQGLT------QLPTLSKNFPF
    AT1G58520   (260)   YRQLWIRKIATLVGAVAFMFVFLIPVTFIQGLT------QLVQLSHAFPF
  Os03g0673800  (349)   YKQLWIRRIVTLSGSIVFMFLFLIPVTFIQGLT------QLEQLQQRLPF
  Os12g0633600  (349)   YKQLWIRRIATLLGSIVFMLFFLIPVTFIQGLS------QLEQLQQRLPF
  Os03g0726300  (349)   YRQIWLRKIATLAASVAFMFVFIVPVAFVQSMM------QLDQIEQLFPS
    AT1G69450   (343)   FMQKWLAKILVVFACLLLTILFLVPVVLVQGLT------NLPALEFMFPF
  Os12g0582800  (335)   FMDRWISKFVVSVASILLILVFLLVSAFVQGLT------YMEQLETWLPF
    AT3G01100   (349)   FVRRWISNVVVLVAFVALLILYIVPVVLVQGLA------NLHQLETWFPF
    AT3G54510   (248)   QKILPLNKIGVILAAALLTIFFAIPVTAVQGIA------KYEKLKKWFPP
  Os01g0950900  (345)   FCRIAIYKLGVFIAAFLLIVFFTIPVTAVQGIV------QFEKIKIWFPF
    AT1G30360   (356)   LFSRIIRQYFIYFFVAVTILFYMIPIAFVSAIT------TLKNLQRIIPF
  Os07g0150100  (366)   IYERQIRQVVVYTIVFLTVVFYMIPITAISALT------TLEKLREKLPF
         YTP1   (366)   IYERQIRQVVVYTIVFLTVVFYMIPITAISALT------TLEKLREKLPF
    AT4G35870   (404)   KVALIVRRVIVNTILLLILVFFSSPLALISALVSAGRIFNAEALDSAQYW
  Os03g0137400  (382)   KTSLGLRRIAVNTCLILMLLFFSSPLAIISGMQSAARIINVEAMDNAKSW
    AT4G02900   (367)   FISLTIRKLVIGVSVFALVFFYMIPIAFVQSLA------NLEGLDRVAPF
  Os10g0579100  (362)   FFSLSIRKFLISIAVFALVFFYMIPIAFVQSLA------NLEGIEKVAPF
  Os05g0393800  (365)   FVELSVRRLIMAVALFFLTFFFMIPIAIVQSMA------NLDDIERMLPF
    AT3G21620   (365)   YVQLTIRRLVIAVAFFFLTFFFMIPIAFVQTLA------NIEGIEKAVPF
    AT4G15430   (367)   YVDLKIRRLIVGVAYFFLTFFFMIPIAFVQSLA------NIEGIEKAFPF
    AT1G11960   (367)   YVSLTHRRH-----------------------------------------
    AT1G62320   (365)   YVSLTVRRFVMHIAFFFLTFFFIIPIAFVQSLA------SIEGIEKSAPF
    AT4G04340   (369)   YVSLTVRRLVMNVAFFFLTFFFIIPIAFVQSLA------TIEGIEKVAPF
    AT4G22120   (368)   YVSLTVRRLIMHVAFFFLTFFFIVPIAFVQSLA------TIEGIVKAAPF
  Os01g0534900  (364)   FVYLTIRRLIIAVAFFFLNFFYVLPIAFVQSLA------NIEGIEKAAPF
  Os05g0594700  (364)   FVSLTVRRLIVAVAFFFLNFFYVIPIAFVQSLA------SLEGIEKALPF
    Consensus   (451)   YV L IRRLVV VA F LMFFFMIPIAFVQSLA       NLE LEK  PF
```

FIGURE 22 (continued)

```
                  501                                               550
AT1G10090   (390) LKDLLNRRFMEQVITGYLP-SVILVLFFYTVPPLMMYFSTLEGCVSRSQR
AT1G58520   (304) LRGILSKNFINQVITGYLP-SVILILFFYAVPPLMMYFSALEGCISRSIR
Os03g0673800 (393) LNGILKKKYITQLVTGYLP-SVILQIFLYTVPPTMMFFSTLEGPVSHSER
Os12g0633600 (393) LKGILEKKYMSQLVTGYLP-SVILQIFLYAVAPIMILFSTLEGPISHSER
Os03g0726300 (393) LKNMLKKPFFVKLVTGYLP-SVVLLLSLYTVPPLMMFFSSIEGSISRSGR
AT1G69450   (387) LSLILSMKVVSQIITGYLP-SLILQFSLKVVPPTMEFLSSIQGHICHSDI
Os12g0582800 (379) LRNILEIAVVSQLVTGYLP-SVILHFLSSYVPSIMKLFSTMQGFISVSGI
AT3G01100   (393) LKGILNMKIVSQVITGYLP-SLIFQLFLLIVPPIMLLLSSMQGFISHSQI
AT3G54510   (292) AMAIEFIPGLSSVVTGYLP-SAILKGFMYIIPFAMLGLAYLGGSISNSKE
Os01g0950900 (389) ARAVELIPGLNSVVTGYLP-SMILNGFIYLIPFAMLGMASFEGCIAKSQK
AT1G30360   (400) IKPVVEITAIRTVLESFLP-QIALIVFLAMLPKLLLFLSKAEGIPSQSHA
Os07g0150100 (410) LKVVVDQPKIKTVLQAYLP-QLALIVFLALLPSLLMFLSKLEGIPSQGHT
YTP1        (410) LKVVVDQPKIKTVLQAYLP------------------------------
AT4G35870   (454) LTWVQTSGWIGSLIFQFLPNVFIFVSMYIVIPSALSYLSKFERHLTVSGE
Os03g0137400 (432) LVWLQSSSWFWTIIFQFLPNVLIFVSMYIIIPSVLSYFSKFECHLTVSGE
AT4G02900   (411) LRPVTRLDFIKSFLQGFLP-GLALKIFLWILPTVLLIMSKIEGYIALSTL
Os10g0579100 (406) LRPVIDTPVVKSFLQGFLP-GLALKIFLYILPTVLMIMSKVEGYVSLSSL
Os05g0393800 (409) LKPIIERNSLKSIVQGFLP-GIALKIFLILLPTFLVMMSKIEGHYSLSGL
AT3G21620   (409) LKPIEVKTVKSFIQGFLP-GIALKIFLIVLPSILMLMSKFEGFISKSSL
AT4G15430   (411) LKPLIEVKLLKSIIQGFLP-GIALKIFLLFLPRILMQMSKFEGFVSTSSL
AT1G11960   (376) --------------------------------------------------
AT1G62320   (409) LSPIVKNKLMKSLIQGFLP-GIVLKLFLIFLPTILMIMSKFEGFISISSL
AT4G04340   (413) LKVIIEKDFIKSLIQGLLA-GIALKLFLIFLPAILMTMSKFEGFTSVSFL
AT4G22120   (412) LKFIVDDKFMKSVIQGFLP-GIALKLFLAFLPSILMIMSKFEGFTSISSL
Os01g0534900 (408) LKPLIEMRTIKSFIQGFLP-GIALKIFLILLPSILMFMSKVEGLTSVSSL
Os05g0594700 (408) LKPLIKIDVIKSFIQGFLP-GIALKVFLILLPTILMFMSKFEGLISQSSL
Consensus   (501) LK IL    IKSVI GFLP   IIL IFL ILP ILM MSKLEG IS S L 551                                               600
AT1G10090   (439) KKSACLKILYFTIWNVFFVNILSGSVIRQFTVLN-------SV-RDVPAQ
AT1G58520   (353) KKSACIKVLYFTIWNVFFVNILSGSVIRQLNVFS-------SV-RDIPAQ
Os03g0673800 (442) KRSACCKVLYFTIWNVFFVNVLSGSAISQVNALS-------SP-KDIPMV
Os12g0633600 (442) KRSACCKVLYFTVWNIFFGNVLSGTVISQLNVLS-------SP-KDIPVQ
Os03g0726300 (442) KKSACCKILFFTIWNVFFVNVLSGSVLNQLNVFT-------RP-RDMPSM
AT1G69450   (436) QKSACNKVIWFTIWNVFFATVFSGSAFYKLSVIL-------DP-KQIPLK
Os12g0582800 (428) ERSACNKMLRFTIWSVFFANVLTGSVLGQLEIFL-------DP-KEIPKR
AT3G01100   (442) EKSACIKLLIFTVWNSFFANVLSGSALYRVNVFL-------RP-KTIPRV
AT3G54510   (341) EIKACNMVFYFLMGNVFFLSLISGSLLDEIGEYLT------HP-RDIPSH
Os01g0950900 (438) EIKACNMVFYFLLGNVFFLSILSGSLLHQIGESFT------HP-KDIPSR
AT1G30360   (449) IRAASGKYFYFSVFNVFIGVTLAGTLFNTVKDIAK-----NPKLDMIINL
Os07g0150100 (459) VRAAAGKYFYFIVFNVFLGVTISSTLFSALTTIIN-----NF--PGIVNM
YTP1        (429) --------------------------------------------------
AT4G35870   (504) QRAALLKMVCFFLVNLIILKALVESSLESALLKMSRCYLDGEDCKRIEEY
Os03g0137400 (482) QRAALLKMVCFFLVNLILLRALVESSLESWILSMGRCYLDSVDCKQIEQY
AT4G02900   (460) ERRAAAKYYYFMLVNVFLGSIIAGTAFEQLHSFLH-----QSP-SQIPRT
Os10g0579100 (455) ERRAASKYYYFMLVNIFLGSIIAGTAFEQLNAFFH-----QPP-SQIPRT
Os05g0393800 (458) DRRTASKYYLFLFVNVFLGSVITGTAFQQLNNFIH-----QSA-NKIPEI
AT3G21620   (458) ERRCASRYYMFQFINVFLCSIIAGTALQQLDSFLN-----QSA-TEIPKT
AT4G15430   (460) ERRAATRFYMFQFINVFLGSIVTGTAFQQLNSFLN-----QSA-NDIPKT
AT1G11960   (376) --------------------------------------------------
AT1G62320   (458) ERRAAFRYYIFNLVNVFLGSVITGSAFEQLDSFLK-----QSA-NDIPRT
AT4G04340   (462) ERRSASRYYIFNLVNVFLGSVIAGAAFEQLNSFLN-----QSP-NQIPKT
AT4G22120   (461) ERRAAFRYYIFNLVNVFLASVIAGAAFEQLNSFLN-----QSA-NQIPKT
Os01g0534900 (457) ERRSAFKYYIFLFFNVFLGSIIAGSALEQLKTFLH-----QSA-NEIPRT
Os05g0594700 (457) ERRSASKYYIFLFFNVFLGSIVTGSALDQLKAYIH-----QSA-NEIPRT
Consensus   (551) ER A  K Y F L NVFLGSVLSGSAL QL  FL          S   DIP
```

FIGURE 22 (continued)

```
                601                                              650
AT1G10090  (481) LAKLVP-AQAGFFMTYCFTSGWAGLACEIMQPVGLIWNLIAKVIVKNKEE
AT1G58520  (395) LARAVP-TQAGFFMTYCFTSGWASLACEIMQPMALIWNLVAKVVTKNEDE
Os03g0673800 (484) LARAVP-VQATFFTTYVLTSGWASLSSELMQLFGLTWNFIMKYVLRMKED
Os12g0633600 (484) LARAIP-VQATFFITYVLTSGWASLSSELMQLFGLIWNFVRKYILRMPED
Os03g0726300 (484) LAELVP-KQATFFITYVLTSGWASLCSEILQVYNLVYNFFRKCIFCYRDD
AT1G69450  (478) LAVAVP-AQASFFIAYVVTTGWTDTLTELFRVVPFMVSYIKRSFEPSDEN
Os12g0582800 (470) LAVVVP-AQASFFITYVVTS-WTSIASELTQTAALLFHLWGSCAKCCKRD
AT3G01100  (484) LAAAVP-AQASFFVSYVVTSGWTGLSSEILRLVPLLWSFITKLFGKEDDK
AT3G54510  (384) LAAAVS-AQAEFFMTYILTDGLSGFSLEILQLGLILFDIIRSYTYGRGKE
Os01g0950900 (481) LARAVS-AQSDFFITYILTDGMSGFSLEVLQFGLLTWHFFKAHSIGHSEQ
AT1G30360  (494) LATSLP-KSATFFLTYVALKFFIGYGLELSRIIPLIIFHLKKKYLCKTEA
Os07g0150100 (502) LASSLP-GSATFFLTFVALKFFVGYGLELSRLVPLIIFHLKRKYLCKTED
YTP1       (429) --------------------------------------------------
AT4G35870  (554) MSPSFLSRSCVSALAFLITSTFLGISFDLLAPIPWIKKKIQKFRKNDMLQ
Os03g0137400 (532) LSPSFLSRSSLSSLAFLITCTFLGISFDLLAPIPWIKHVMKKFRKNDMVQ
AT4G02900  (504) IGVSIP-MKATFFITYIMVDGWAGIAGEILRLKPLVIFHLKNMFIVKTEE
Os10g0579100 (499) IGVAIP-MKATFFMTYIMVDGWAGIANEILRVKPLVIYHLKNMFIVKTER
Os05g0393800 (502) VGESIP-MKATFFITYVMVDGWAGVAAEVLRLKPLVMFHIKNTFLVRTER
AT3G21620  (502) IGVSIP-MKATFFITYIMVDGWAGVAGEILRLKPLIIYHLKNFFLVKTEK
AT4G15430  (504) IGVSIP-MKATFFITYIMVDGWAGVAGEILRLKPLIIYHLKNSFLVRTEK
AT1G11960  (376) --------------------------------------------------
AT1G62320  (502) VGVAIP-IKATFFITYIMVDGWAGVAGEIFRLKPLVIFHLKNFFVKTEK
AT4G04340  (506) IGMAIP-MKATFFITYIMVDGWAGVAGEILMLKPLIIYHLKNAFLVKTEK
AT4G22120  (505) IGVAIP-MKATFFITYIMVDGWAGVAGEILMLKPLIMFHLKNAFLVKTDK
Os01g0534900 (501) IGEAIP-MKATFFITYVMVDGWAGVAGEILRLKPLIIFHLKNFFLVKTEK
Os05g0594700 (501) IGVAIP-MRATFFITYVMVDGWTGVAGEILRLRALIIFHLKNFFLVKTEK
Consensus  (601) LA AIP   ATFFITYVM  GWAGVA EIL L PLII HLK   FL KTE 651                                              700
AT1G10090  (530) ----SYETLRFPYHTEIPRLLLFGLLGFTNSVIAPLILPFLLIYFFFAYL
AT1G58520  (444) ----SYETLRFPYHTEIPRLLLFGLLGFTNSVIAPLILPFLLIYFFLAYL
Os03g0673800 (533) ----SYFVPSFPYHTEVPKVLLFGLLGFTCSVLAPLILPFLLVYFFLGYV
Os12g0633600 (533) ----TEFVPSFPYHTEVPKVLLFGLLGFTCSVLAPLILPFLLVYFFLGYI
Os03g0726300 (533) ----PEYGYSFPYHTEVPKVLLFNLLGFTFSIMAPLILPFLLVYFCLGYL
AT1G69450  (527) ----EFVVPFMRYHRDTPRVLFFGLLGITYFFLAPLILPFILLYFILAYI
Os12g0582800 (518) ----ESKPPSMHYHSEIPRVLLFGLLGLTYFIVSPLILPFVLVYFCLGYF
AT3G01100  (533) ----EFEVPSTPFCQEIPRILFFGLLGITYFFLSPLILPFLLVYYCLGYI
AT3G54510  (433) R---TPYLFSFPYFRVIPTVSLSIMIGMIYAVVAPLMLPFLVGYFCLGYI
Os01g0950900 (530) -----PYLYGFPYYRVVPIVSLAVLIGLVYAVVAPLLLPILVIYFLLGYA
AT1G30360  (543) EVKEAWYPGDLSYATRVPGDMLILTITFCYSVIAPLILIFGITYFGLGWL
Os07g0150100 (551) EVRAAWAPGDLGYNTRVPNDMLIVTIVLCYSVIAPLIIPFGVAYFALGWI
YTP1       (429) --------------------------------------------------
AT4G35870  (604) LVPEQNEEYALENQ-EPSSNLETPLLPENMFESPRFGDIEPMSQDLSEYP
Os03g0137400 (582) LVPEENEDYQLMHDGEETNNLRAPLMSEREDSGILNG---IEEHDLSLYP
AT4G02900  (553) DRVRAMDPGFVDFKETIPSLQLYFLLGIVYTAVTPILLPFILIFFAFAYL
Os10g0579100 (548) DRERAMDPGSIGLAENLPSLQLYFLLGLVYAVVTPILLPFIIIFFAFAFL
Os05g0393800 (551) DREQAMDPGSLDFGTTEPRIQLYFLLGLVYAVVTPILLPFIIVFFSLAYL
AT3G21620  (551) DREEAMDPGTIGFNTGEPQIQLYFILGLVYAAVSPILLPFILVFFALAYV
AT4G15430  (553) DREEATDPGTIGFNTGEPQIQLYFLLGLVYAAVSPILLPFILVFFGLAFV
AT1G11960  (376) --------------------------------------------------
AT1G62320  (551) DREEAMDPGQIDFYATEPRIQLYFLLGLVYAPVTPVLLPFIIFFFGFAYL
AT4G04340  (555) DREEAMNPGSIGFNTGEPQIQLYFLLGLVYAPVTPMLLPFILVFFALAYV
AT4G22120  (554) DREEAMDPGSIGFNTGEPRIQLYFLLGLVYAPVTPMLLPFILVFFALAYI
Os01g0534900 (550) DREEAMDPGSIGFDSNEPQIQLYFLLGLVYAVVTPFLLPFILIFFGLAYV
Os05g0594700 (550) DREEAMDPGSICFDWCEPRIQLYFLLGLVYAVVTPLLLPFILVFFGLAYV
Consensus  (651)      A DP SI Y T IP I LY LLGL YAVVAPLLLPFILVYF LAYL
```

FIGURE 22 (continued)

```
                     701                                              750
   AT1G10090   (576) IYKNQIINV----YITKYESGGQYWPVFHNTTIFSLILSQVIALGFFGLK
   AT1G58520   (490) IYKNQILNV----YITKYESGGQYWPIFHNTTIFSLILTQIIALGFFGLK
 Os03g0673800  (579) VYRNQFLNV----YCTKYDTGGLYWPIAHYTTIFSIVLTQIICLGVFGLK
 Os12g0633600  (579) VYRNQLLNV----YRTRYDTGGLYWPIAHNAVIFSLVLTQIICLGVFGLK
 Os03g0726300  (579) VYRNQILNV----YYPKYEMGGKLWPIMHSTLVFALVLTQTIALGVFTIK
   AT1G69450   (573) IYRNQFMNV----YAPKFDTGGMFWPMIHYTMIFSLVLMQAIAIGLFALK
 Os12g0582800  (564) IYRNQLFNV----YSPKYDTGGRFWPIVHGGTIFSLVLMHVIAIGVFGLK
   AT3G01100   (579) IYRNQVT----------------EPIS--LLSIILC--------------
   AT3G54510   (480) VYFNQMEDV----YETTYDTCGRFWPFIHHYIFVSIILMQITMVGLFGLK
 Os01g0950900  (575) VYINQMEDV----YEITYDTCGQYWPNIHRYIFLSVTLMQITML-----K
   AT1G30360   (593) VLRNQALKV----YVPSYESYGRMWPHIHQRILAALFLFQVVMFGYLG-A
 Os07g0150100  (601) IVKNQVLRV----YVPSYESNGRMWPHMHTRIIAALLIYQITMVGVIL-L
      YTP1     (429) --------------------------------------------------
   AT4G35870   (653) ISRTSPIPKQKFDFAQYYAFNLTIFALTMIYSSFAPLVVPVGAVYFGYRY
 Os03g0137400  (629) INRSFHMPKQTFDFAQYYAFDITIFALTMIYSLFAPLTVPVGAVYFGYRY
   AT4G02900   (603) VYRHQIINV----YNQQYESCGAFWPHVHSRIIASLLISQLLLMGLLASK
 Os10g0579100  (598) VYRHQIINV----YNQEYESAAAFWPQVHSRIIASLLISHVTLFGLMSTM
 Os05g0393800  (601) VFRHQIINV----YNQQYESGAQFWPDVQRRLVIALIVSQILLLGLLSTQ
   AT3G21620   (601) VYRHQIINV----YNQEYESAAAFWPDVHRRVVIALIVSQLLLMGLLSTK
   AT4G15430   (603) VYRHQVINV----YNQKYESAGKFWPDVHRRVVTALVVSQLLLMGLLSTK
   AT1G11960   (376) --------------------------------------------------
   AT1G62320   (601) VFRH----------QKYESAGAFWPDVHGRIISALIISQILLLGLMSTK
   AT4G04340   (605) VYRHQIINV----YNQEYESAAAFWPDVHGRVITALIISQLLLMGLLGTK
   AT4G22120   (604) VYRHQIINV----YNQEYESAAAFWPDVHGRVIAALVISQLLLMGLLGTK
 Os01g0534900  (600) VYRHQIINV----YNQEYESAAAFWPSVHGRIIVALIVSQLLLLGLLSTK
 Os05g0594700  (600) VYRHQIINV----YNQQYESGAQFWPSVHGRIIIALIVSQLLLIGLLSTK
    Consensus  (701) VYR QIINV    Y  YESGG FWP VH  II ALILSQILLLGL   K 751                                              800
   AT1G10090   (622) LSTVASGFTIPLILLTLLFSEYCRQRFAPIFQKYPAE-ILIAMDRADEMT
   AT1G58520   (536) LSTVASGFTIPLILLTLLFSEYCRQRFAPIFNKNPAQ-VLIDMDRADEIS
 Os03g0673800  (625) ESPVAAGFTVPLIILTLLFNQYCSNRLRPLFKTLPAQ-DLIDMDREDEQS
 Os12g0633600  (625) ESPVAAGFTIPLIILTLLFNQYCRNRLLPLFRTTPAQ-DLIDMDREDERS
 Os03g0726300  (625) HATISSGFTVLLIIGTVLFHQYCRHRFSSIFNSFSAQ-DLIEMDRDDEQS
   AT1G69450   (619) KMELATYLLVPLPVFTLLFNEFCRKRFMPIFTDYPAE-VLTKRDKEDRND
 Os12g0582800  (610) KLPLASSLLVPLPVLTLLFNEYCRNRFLPIFEAYSTE-SLIKKDREEESK
   AT3G01100   (597) --------------------------------------------------
   AT3G54510   (526) SKPSAAIATVPLILITIAYNEYCKIRFLPSFKHFPIQ-TAVEIDEEDEKN
 Os01g0950900  (616) SKPGASFATVPLLVSTILFNEYCKVRFLPTFLHRPVQ-VAKENDDLNEAE
   AT1G30360   (638) KTFFYTALVIPLIITSLIFGYVCRQKFYGGFEHTALEVACRELKQSPDLE
 Os07g0150100  (646) KKFLYSPVLVPLIPISFIFAYICHMRFYPAFAKTPLEVVQHNVKDTPNMD
      YTP1     (429) --------------------------------------------------
   AT4G35870   (703) IVDKYNFLYVYRVRGFPAGNEGKLMDTVLCIMRFCVDLYLVSMLLFFSVK
 Os03g0137400  (679) LVDKYNFLFIYRVRGFPAGNDGKLMEMVICIMQFCVIFFLVAMLLFFAVQ
   AT4G02900   (649) KAADSTPLLIILPILTLSFHKYCKHRFEPAFRQYPLE-EAMAKDKLEKET
 Os10g0579100  (644) KAAYSTPLLIFLPLLTIWFHKYCKSRFEPAFRKYPLE-EAMEKDNLERTS
 Os05g0393800  (647) EAEKSTVALLPLPVLSIWFHYVCKGRFEPAFIKFPLQ-DAMVKDTLERAN
   AT3G21620   (647) KAARSTPLLFILPVLTIGFHKFCQGRYQPIFVTYPLQ-DAMVKDTLERMR
   AT4G15430   (649) HASKSTPLLLVLPLLTIGFHKRCKNRYQPAFVTYPLQQEAMIKDTLDRIR
   AT1G11960   (376) --------------------------------------------------
   AT1G62320   (640) GKVQSTPFLLVLAILTFGFHRFCKGRYESAFVINPLQ-EAMIKDTLERAR
   AT4G04340   (651) HAASAAPFLIALPVITIGFHRFCKGRFEPAFVRYPLQ-EAMMKDTLERAR
   AT4G22120   (650) HAALAAPFLIALPVLTIGFHHFCKGRYEPAFIRYPLQ-EAMMKDTLETAR
 Os01g0534900  (646) GAGQSTPVLLVLPVVTFYFYKYCKNRYEPAFVEYPLQ-DAMRKDTLERAR
 Os05g0594700  (646) GFEETTPVLVVLPVLTFWFYKYCKNRFEPAFVRNPLQ-EAMRKDTLERAR
    Consensus  (751)    A  AT  LI L VLTI F YCK RF P F  YPLQ EAM  D   E
```

FIGURE 22 (continued)

```
                   801                                              850
AT1G10090   (671) GKMEEIHNNLKVAYSQIPTCSEESS-KA------GCT--SPCSDQELPDS
AT1G58520   (585) GKMEELHKKLHNVYSQIPLHSQKSSSKA------ECS--NPFKKQELPDP
Os03g0673800 (674) GRMDDIHHRLHSAYCQFADTDDIPLKGV------HVD--RDADASGSSGE
Os12g0633600 (674) GRMDEIHHRLHSAYCQFHDTEDIPLEKI------QTV--GSDEEQGCSSD
Os03g0726300 (674) GRMEEIHKHLLDAYSQGTTNMDN-SSSS------RNG--GAPIEMIMEDP
AT1G69450   (668) PTMPEFYNNLVSAYKDPALLPLRFSGSG------SRN--DSLTSPLLSFS
Os12g0582800 (659) PEMAEFFSNLVNAYCDPAMKPIQHS---------SNS--DERTTPLLS--
AT3G01100   (597) --------------------------------------------------
AT3G54510   (575) GEMETHYVDAATAYNRHQPCLERVSSAE------SPT--NLSQPLLGTDS
Os01g0950900 (665) G----MRGDLDHAISAYKPPWMRPTNFS------PDC--SSVQPLIRSV-
AT1G30360   (688) EIFRAYIPHSLSSHKPEEHEFKGAMSRYQDFNAIAGV--------------
Os07g0150100 (696) AVYTSYIPACLKPEKLEDVDIFEDAQLHTTSRAPSI---------------
YTP1        (429) --------------------------------------------------
AT4G35870   (753) GDSTKLQAIFTLGVLVMYKLLPSDTDRYHPALLRSIQTVDSIIDGPVDYE
Os03g0137400 (729) GDPMKLQAICTLSLLVFYKLLPSRSDRFQPSLLEGMQTVNSFVDGPTDYE
AT4G02900   (698) EPELNMKADLADAYLHPIFHSFEKEVELSSSSSSEKETHQEETPEVRVDK
Os10g0579100 (693) EPNLNLKSYLQNAYLHPIFHMFEQQQQQ------EQEQQREEKVEVRIDK
Os05g0393800 (696) DPTLNLREYLKDAYVHPVFQKNDIYEFAG----IDEE---EKNPMVATKR
AT3G21620   (696) EPNLNLKTFLQNAYAHPVFKAADNLANEM----VVEEPAPDKTPDLVATK
AT4G15430   (699) EPNLNLKAFLRDAYAHPEFRVGEDPEPEE----KLES--DMSPPDLVATK
AT1G11960   (376) --------------------------------------------------
AT1G62320   (689) EPNLNLKGFLQNAYVHPVFKDEEDSDEEG----LIEDSDDEDCVVVQTKR
AT4G04340   (700) EPNLNLKGYLQDAYIHPVFKGGDNDDDG-----DMIGKLENEVIIVPTKR
AT4G22120   (699) EPNLNLKGYLQNAYVHPVFKGDEDDYDID----DKLGKFEDEAIIVPTKR
Os01g0534900 (695) EPGFDLKGYLMNAYIHPVFK-GDEDDEKF----SISDEPEAEQVLVATKR
Os05g0594700 (695) EPTFDLKAYLANAYLHPVFK-GREEEDNM----SISEDVGMEEVIVPTKR
Consensus   (801)       L   L  AY                                 V 851                                              900
AT1G10090   (712) EELKPEKENLKADYIWEFQRSK---SGLDLEVKSCPSASPIRNSPGFAEI
AT1G58520   (627) EKLKPEEGDAIAKELWGFQGNE---SGQEHDTKS----------------
Os03g0673800 (716) SSCKEDTNQPTTSDISHPTLEGLPVNRLRHAVRSLSSIIRLQKRGLSPQP
Os12g0633600 (716) KSNGKESFEEPRAELSHPTLNGLPVSRLRHAVKSITFLVRLQKRGLSE--
Os03g0726300 (715) AQDAQDSNQE---------------LCDAVKEVTGSIQEHADEM----
AT1G69450   (710) EV------------------------------------------------
Os12g0582800 (696) --------------------------------------------------
AT3G01100   (597) --------------------------------------------------
AT3G54510   (617) I-------------------------------------------------
Os01g0950900 (702) --------------------------------------------------
AT1G30360   (725) --------------------------------------------------
Os07g0150100 (732) --------------------------------------------------
YTP1        (429) --------------------------------------------------
AT4G35870   (803) AYSHPNFDWDTYNNR-----------------------------------
Os03g0137400 (779) VFSQPDLDWSLYQS------------------------------------
AT4G02900   (748) HETQSSSPVTELGTSS----------HHHHVYNSTSPSSHYASAYEQSSS
Os10g0579100 (737) AQQHHHRQVEEEEEESKSSQATTHYYHHHHEQTTTTTHHHYHQHEHMSHY
Os05g0393800 (739) Q-SRMNTPVDSKFNSS----------------SGTNEGEFSRMAPT--
AT3G21620   (742) RGSRRFNSGSAETFT-----------------------------------
AT4G15430   (743) RWSWRNTPLPSKDSCR----------------EIP-------------
AT1G11960   (376) --------------------------------------------------
AT1G62320   (735) QRSRRTTVASSNASRG----------------SSQSTPFNQLDLGKGK
AT4G04340   (745) Q-SRRNTPAPSRISGE----------------SSPSLAVINGKEV---
AT4G22120   (745) Q-SRRNTPAPSIISGD----------------DSPSLPFS-GKLV---
Os01g0534900 (740) Q-SRRNTPVPSKYNGS----------------ESPSLAEIVNDQRL--
Os05g0594700 (740) Q-SRRNTPAQSKYEGS----------------DTLSLPETVHER----
Consensus   (851)
```

FIGURE 22 (continued)

```
                          901                        924
AT1G10090    (759)   YKRT--------------------
AT1G58520    (658)   ------------------------
Os03g0673800 (766)   AGPSADVNPQTA------------
Os12g0633600 (764)   ------------------------
Os03g0726300 (744)   ------------------------
AT1G69450    (712)   ------------------------
Os12g0582800 (696)   ------------------------
AT3G01100    (597)   ------------------------
AT3G54510    (618)   ------------------------
Os01g0950900 (702)   ------------------------
AT1G30360    (725)   ------------------------
Os07g0150100 (732)   ------------------------
     YTP1    (429)   ------------------------
AT4G35870    (818)   ------------------------
Os03g0137400 (793)   ------------------------
AT4G02900    (788)   QYEYHYNTHQYEEHEYRYN-----
Os10g0579100 (787)   HMGPSDTADSPSPPHFVYHYGVDP
Os05g0393800 (768)   ------------------------
AT3G21620    (757)   ------------------------
AT4G15430    (762)   ------------------------
AT1G11960    (376)   ------------------------
AT1G62320    (767)   PET---------------------
AT4G04340    (773)   ------------------------
AT4G22120    (772)   ------------------------
Os01g0534900 (769)   ------------------------
Os05g0594700 (767)   ------------------------
 Consensus   (901)
```

SEQ ID NO: 408, DNA - Oryza sativa
ATGGACACCGCGTCGTTCGTGACGTCGCTGCTGACGTCGTTCGTGATCTTCGTCGTGCTGGTGCTG
GTGTTCACGTGGCTGTCGAGCAGGCCGGGCAATGCGCCGGTGTACTACCCGAGCGTCCTGCTGCGG
GGGCTCGACCCGTGGGAGGGGCGGGGCGGGGACGAGGAGCCCCGTCGGGTGGCTGCGCCAGGCG
ATCTCCGCCTCGGAGGGTGACGTCGTCGCCGTCGGCGGGGTCGACGCCGCCGTCTACCTCGTCTTC
CTCTCCTCCGTGTTGTCCATCTTGGTGTTCTCTGGGATTGTGCTGCTTCCAGTTCTGCTACCTGTT
GCTGCTACTGACGATAACCTGAACCTGGAGAGGGCCATTGGCCTGAAGAACGGCAAAACACCCCAG
AACTTCACAGAGCTCGAGAAATTAGCACTGGGCAATGTTCAAGAACATAGCCGAAGGCTGTGGGCA
TTTCTATTATCAGTCTATTGGGTCTCTTTTGTCACGTACTTCGTACTATGGAAGTCCTACAAGCAT
GTTTCTAATATGAGAGCGGCTGCAAGATCAACACCAGATGTTAAACCGGAGGAGTTTGCTGTGTTG
GTGAGAGATGTTCCTAAGCCACCTCCTGATCAAACTATAAAGGATTCTGTAGACTCATATTTCCGA
GCACTTCATCCTGATACCTTCTACAGATCAATGGTTGTGACTGACCACACAAAGGCTGACAAAATT
TATCAAGAGATTGAAGGTCACAAACAGAAAATTGCTCGTGCTGAAGTTGTCTATGCGGAGTCTAAA
ACAACAGGCAAGCCTGAGGGCACCAAGCCTACGCATCGGATTGGATTTCTTGGTCTTATCGGTAAA
AAGGTTGATACAATTGAGTATTGTAATGACCAAATCAAGGAGTTGCTGCCCAAACTGGAGGCCGAA
CAGAAGACTACCCTTCGTGAGAAACAGCAACAGGCTGCAATTGTGTTTTTCAACAGAAGATCTGCT
GCAGCTTCTGCATCTCAGACTCTCCATGCTCAGATGTTTGATAAATGGACTGTTGAGCAGGCTCCT
GAACCACGCCAGATAATATGGTCTAATCCTTCCAAGAAAATATATGAGAGGCAAATCAGACAGGTT
GTGGTCTATACCATTGTCTTTCTCACAGTGGTTTTCTATATGATTCCTATTACTGCTATCTCTGCT
CTTACAACTTTGGAGAAGTTGAGGGAGAAGCTTCCCTTTCTGAAGGTGGTGGTGGACCAACCGAAA
ATCAAGACTGTCCTACAGGCTTACCTCCCGTAG

SEQ ID NO: 409, protein - Oryza sativa
MDTASFVTSLLTSFVIFVVLVLVFTWLSSRPGNAPVYYPSVLLRGLDPWEGRGRGTRSPVGWLRQA
ISASEGDVVAVGGVDAAVYLVFLSSVLSILVFSGIVLLPVLLPVAATDDNLNLERAIGLKNGKTPQ
NFTELEKLALGNVQEHSRRLWAFLLSVYWVSFVTYFVLWKSYKHVSNMRAAARSTPDVKPEEFAVL
VRDVPKPPPDQTIKDSVDSYFRALHPDTFYRSMVVTDHTKADKIYQEIEGHKQKIARAEVVYAESK
TTGKPEGTKPTHRIGFLGLIGKKVDTIEYCNDQIKELLPKLEAEQKTTLREKQQQAAIVFFNRRSA
AASASQTLHAQMFDKWTVEQAPEPRQIIWSNPSKKIYERQIRQVVVYTIVFLTVVFYMIPITAISA
LTTLEKLREKLPFLKVVVDQPKIKTVLQAYLP

SEQ ID NO: 410, DNA - Oryza sativa
ATGGCTACTATTCAAGATATAGGTGTCTCTGCAGCTATCAACATACTGAGTGCCATCACTTTCCTG
CTAGCGTTTGCTTTCCTGCGACTACAGCCCATCAACGATAGGGTTTACTTCCCAAAGTGGTATCTC
AAAGGTGCAAGAGAGAGTCCAAGTCATGGGGGTGCATTTGTGCGGAAGTTTGTCAATTTGGACATG
CGATCATACTTGAAGGTCTTAAGTTGGATGCCTGCTGCTCTCAAAATGCCAGAGGATGAGTTAATT
AGCCATGCAGGCCTTGATTCAGCTGTCTATCTGCGGATCTACTTAATAGGGCTTAAAATATTTGCT
CCAATCACAGTTCTAGCATTTATTATTCTTGTGCCTGTTAATTGGACCAATATTACCCTTCAAAGC
TCGAAGGTGCAGCACAGTGATATTGACAAACTTTCAATATCCAACATACCTGTAGGGTCAAAGAGG
TTCGCAGCTCACCTGACCATGGCTTATGTTTTCACATTTTGGACATGCTATGTGCTGTTACGGGAG
TATGAAATAGTGGCAACAATGCGTCTGCGCTTTCTTGCATCAGAGAAGCGCCGCCCAGATCAGTTC
ACGGTCCTTGTGCGGAATATACCGCCTGATCCTGATGAATCAATTGGTGAGCTTGTGAACATTTC
TTCCTTGTAAACCATCCTGACCATTATCTTACGCACCAGGTTGTCTATAATGCAAATAAGCTTGAT
AAGATGGTCAAAGAGAAGAAGAAAATGCAGAATTGGCTTGATTACTATCAGCTGAAATATGAAAGA
AATACATCTCAAAGGCCTACTACAAAGACTGGTTTTCTTGGATGTTTTGGTTCAAAGGTGGATGCT
ATTGAATACTACACATCTGAAATTGAGAGGATAGAAAAGGAAGAAACTGATGAACGTGGAAAGATT
ATGAAGGATCCAAAATCAGTTGTGCCAGCAGCCTTTGTTTCCTTCCGATCGCGGTGGGGAGCAGCA
GTGTGTGCTCAGACACAGCAAACCAGTAATCCAACTGTCTGGTTGACCGAGTGGGCCCCAGAACCT

FIGURE 24

CGTGATGTCTATTGGGATAACCTCTCTATTCCTTTTGTTTACCTGACAATTAGGAGGCTGATAATT
GCGGTTGCATTCTTCTTCCTGAACTTCTTTTATGTGCTCCCGATTGCATTTGTTCAGTCCCTTGCA
AATATTGAAGGGATTGAGAAGGCAGCTCCATTTCTGAAGCCTTTGATTGAAATGCGTACTATTAAA
TCATTCATCCAAGGATTTCTGCCAGGAATTGCTCTGAAGATTTTCCTTATATTGCTCCCTAGCATA
TTAATGTTTATGTCTAAAGTTGAAGGATTGACATCGGTGTCCTCACTGGAGAGGAGATCTGCTTTT
AAGTACTATATCTTCTTGTTCTTTAATGTATTCTTGGGAAGCATTATTGCAGGATCTGCTTTAGAG
CAGCTCAAAACATTTCTTCACCAATCAGCAAATGAAATACCAAGGACAATTGGTGAAGCAATTCCA
ATGAAAGCAACCTTTTTTATAACATATGTAATGGTTGATGGTTGGGCTGGGGTAGCTGGTGAAATT
TTAAGATTGAAACCATTGATAATCTTCCACTTGAAAAACTTTTTCTTGGTCAAGACTGAGAAAGAC
AGAGAAGAAGCAATGGACCCTGGAAGCATTGGTTTTGACTCAAATGAGCCTCAAATACAGCTCTAT
TTCTTGCTCGGACTTGTCTATGCTGTGGTGACACCATTTTTGCTTCCTTTCATATTAATATTCTTT
GGGTTAGCATATGTGGTATACCGTCACCAGATAATAAATGTGTACAACCAAGAATATGAAAGTGCA
GCAGCATTTTGGCCAAGTGTTCATGGACGCATAATTGTAGCATTAATCGTATCACAGCTGCTTCTC
CTTGGATTACTAAGCACAAAAGGTGCTGGCCAGTCAACACCGGTGCTCCTTGTTCTCCCTGTTGTA
ACCTTTTATTTCTATAAATACTGCAAGAATCGCTATGAGCCTGCTTTTGTGGAATATCCATTACAG
GATGCAATGCGGAAGGATACCCTAGAACGCGCAAGAGAGCCAGGGTTCGACCTCAAAGGATACCTG
ATGAATGCCTACATCCACCCGGTGTTCAAAGGCGACGAGGACGACGAGAAGTTCTCCATCTCCGAC
GAACCAGAGGCGGAGCAGGTTCTCGTGGCGACAAAGCGCCAGTCCAGACGGAACACCCCAGTTCCG
AGTAAATACAATGGCTCTGAATCACCTTCCCTTGCTGAAATTGTAAATGATCAACGGCTATAA

SEQ ID NO: 411, protein - Oryza sativa
MATIQDIGVSAAINILSAITFLLAFAFLRLQPINDRVYFPKWYLKGARESPSHGGAFVRKFVNLDM
RSYLKVLSWMPAALKMPEDELISHAGLDSAVYLRIYLIGLKIFAPITVLAFIILVPVNWTNITLQS
SKVQHSDIDKLSISNIPVGSKRFAAHLTMAYVFTFWTCYVLLREYEIVATMRLRFLASEKRRPDQF
TVLVRNIPPDPDESIGELVEHFFLVNHPDHYLTHQVVYNANKLDKMVKEKKKMQNWLDYYQLKYER
NTSQRPTTKTGFLGCFGSKVDAIEYYTSEIERIEKEETDERGKIMKDPKSVVPAAFVSFRSRWGAA
VCAQTQQTSNPTVWLTEWAPEPRDVYWDNLSIPFVYLTIRRLIIAVAFFFLNFFYVLPIAFVQSLA
NIEGIEKAAPFLKPLIEMRTIKSFIQGFLPGIALKIFLILLPSILMFMSKVEGLTSVSSLERRSAF
KYYIFLFFNVFLGSIIAGSALEQLKTFLHQSANEIPRTIGEAIPMKATFFITYVMVDGWAGVAGEI
LRLKPLIIFHLKNFFLVKTEKDREEAMDPGSIGFDSNEPQIQLYFLLGLVYAVVTPFLLPFILIFF
GLAYVVYRHQIINVYNQEYESAAAFWPSVHGRIIVALIVSQLLLLGLLSTKGAGQSTPVLLVLPVV
TFYFYKYCKNRYEPAFVEYPLQDAMRKDTLERAREPGFDLKGYLMNAYIHPVFKGDEDDEKFSISD
EPEAEQVLVATKRQSRRNTPVPSKYNGSESPSLAEIVNDQRL

SEQ ID NO: 412, DNA - Oryza sativa
ATGGACGCGGAGGGGTTGCTGGCGTCGGCGGCGATCAACCTGGGCCTGGCGCTGGTGGCGCTCTCG
CTCTTCTCCTTGCTCAAGAAGCAGCCCGGCAACGCGCCGGTGTACCTTGCGCGGCGGATGGCCGCC
GGTGGCGGTGGGGGCGGGCTGCCGCTCGGCCACGGGCGGTTGACCCCGTCGTTCCGGTGGATCCGC
GCCGCGCTCCGGCTCTCCGAGGACGACGTGCTGCGGCGCCACGGCCTCGACGCGCTCGTCGTCGTC
CGCCTCTTCAAATTCGGGATCAAGTGCTTCGCTGTTTGCTCAATCGTTGGATTGTTCATCCTTGCA
CCAACAAATTATTCCTGTGAAGGTCTACAAGACACCAAAAGGTCAAATTCAATGGAACTTTTCACG
GTATCCAATGTGGCAAGGGGTTCTAACAGGCTTTGGGTGCATTTTGCATGCCTCTGCTTCATATCA
TTCTATGTGGTGTATTTGCTTCATAAGGAGCACAAAGAAATGTCCAGCAGAAGAATTGCACATTTG
AAGTATCACAGGAAACGGCCTGACCAATATACCATTTTAGTTCGAGGAATTCCACTATGCCCAGAT
CATGGAACTTATGGGTGTTATGCTGACCACTTCTTCTCAAAGCACTACCGAACATACCAATCGTAT
CACATAGTACACGACATTGGAAACATCAAGGCACTTCAGAAGTTGGCATCCTCCCTTGAGGACAAG
ATAAAGAGGAAAGAGAAACCAGAAGATGTAACTTTTGGAAGTGGATCTGGTTTAAGTTGACATTA
GAAGCGATAGATACTCGCAAACTGGAAGAAAAACTGAAGAACGTCCATCACTCTATCCGCCTCCTA FIGURE 24 (continued)

```
CAGTGTGAAAATATGCTTAAACGGAAGGAATTACCGGTTGCTTTTGTCTCATTCAAATCACAGCTG
GATGCTGCCCAAGCTGCCGAAATGCAACAGCATGTCAATCCTCTGTCCTTGGTGACAACATATGCT
CCTGAACCACCTGATGCACTATGGACAAATCTGGCTATTCCTTTCTGCCGTATTGCTATATACAAA
CTTGGTGTCTTCATTGCTGCGTTTCTGCTAATAGTGTTCTTCACCATCCCTGTCACAGCTGTGCAA
GGGATAGTACAATTTGAGAAAATTAAAATATGGTTTCCACCGGCTAGAGCTGTGGAACTTATACCA
GGTTTGAATTCTGTCGTAACTGGGTATCTTCCAAGCATGATCTTGAATGGCTTTATCTACTTGATT
CCCTTCGCGATGCTTGGCATGGCATCATTTGAGGGATGCATTGCAAAAGTCAGAAGGAAATCAAG
GCCTGCAACATGGTATTTTACTTCTTGTTAGGGAATGTTTTCTTTTTGAGCATTCTTTCTGGTTCT
CTACTCCACCAGATAGGAGAATCCTTTACACATCCAAAAGACATACCTAGCCGTCTGGCCCGTGCT
GTTTCTGCACAGTCAGATTTCTTCATCACATACATTTTGACCGACGGCATGTCAGGGTTTTCCTTG
GAGGTTCTTCAGTTTGGTTTGCTTACATGGCATTTCTTCAAGGCACATTCAATTGGACATAGTGAG
CAGCCATATCTTTATGGCTTCCCTTACTACAGAGTTGTGCCCATCGTTTCCCTTGCAGTATTGATT
GGGTTGGTCTATGCTGTTGTTGCGCCTCTTCTACTTCCAATTCTTGTTATCTACTTTTTGCTTGGT
TACGCAGTGTACATCAACCAGATGGAAGATGTATATGAGATTACATATGATACTTGTGGACAATAT
TGGCCCAATATTCATCGCTACATCTTCCTTTCGGTCACACTCATGCAAATTACAATGCTGAAGTCG
AAACCGGGGGCTTCATTCGCCACGGTTCCCTTGCTTGTGTCAACCATTTTGTTCAATGAGTACTGC
AAGGTTCGGTTTCTTCCAACTTTCCTTCATCGACCGGTTCAGGTTGCCAAGGAGAATGACGACCTT
AATGAAGCTGAGGGGATGAGAGGTGACCTGGACCATGCCATTAGCGCCTATAAGCCACCATGGATG
CGCCCGACGAACTTCTCTCCAGATTGTAGTTCGGTACAACCTTTGATCCGTTCTGTATAG
```

SEQ ID NO: 413, protein - Oryza sativa
```
MDAEGLLASAAINLGLALVALSLFSLLKKQPGNAPVYLARRMAAGGGGGGLPLGHGRLTPSFRWIR
AALRLSEDDVLRRHGLDALVVVRLFKFGIKCFAVCSIVGLFILAPTNYSCEGLQDTKRSNSMELFT
VSNVARGSNRLWVHFACLCFISFYVVYLLHKEHKEMSSRRIAHLKYHRKRPDQYTILVRGIPLCPD
HGTYGCYADHFFSKHYRTYQSYHIVHDIGNIKALQKLASSLEDKIKRKRETRRCNFWKWIWFKLTL
EAIDTRKLEEKLKNVHHSIRLLQCENMLKRKELPVAFVSFKSQLDAAQAAEMQQHVNPLSLVTTYA
PEPPDALWTNLAIPFCRIAIYKLGVFIAAFLLIVFFTIPVTAVQGIVQFEKIKIWFPPARAVELIP
GLNSVVTGYLPSMILNGFIYLIPFAMLGMASFEGCIAKSQKEIKACNMVFYFLLGNVFFLSILSGS
LLHQIGESFTHPKDIPSRLARAVSAQSDFFITYILTDGMSGFSLEVLQFGLLTWHFFKAHSIGHSE
QPYLYGFPYYRVVPIVSLAVLIGLVYAVVAPLLLPILVIYFLLGYAVYINQMEDVYEITYDTCGQY
WPNIHRYIFLSVTLMQITMLKSKPGASFATVPLLVSTILFNEYCKVRFLPTFLHRPVQVAKENDDL
NEAEGMRGDLDHAISAYKPPWMRPTNFSPDCSSVQPLIRSV
```

SEQ ID NO: 414, DNA - Oryza sativa
```
ATGGGGCCGACCGCGCCGCCGGACGCCGGCGGCGGGGAGCCGGAGGCGTGGTACGGCAGCATC
CAGTACCTGGTCAACATCTCCGCGGTGGGGGCCGCCTCCTGCGTGCTCCTCTTCCTCCTCGTCAAG
CTCCGCTTCGACCACCGCCGCATCCCGGGGCCCTCCGCGCTCGCCGCCAAGCTCCTCGCCGTCTAC
CACGCCACCGCGCCGCAGATCGCGCTCCACTGCGGGGCCGACGCCGCCCAGTTCCTCCTCTTCGAG
CGCGCCTCCTTCCTCGTGCTCGCCGCCGTGGCCGCCGCCGCCGTCGCCGCCGCCCTCCCGCTCAAC
CTCCTCGCCGGGGACGCCGCCATCGCCGACCAGTTCGCCGCCACCACCATCTCCCACATCCCCAAG
TCATCCCCGCTCCTCTGGCTCCATCTCCTCCTCACCGCCGCCGTCGTCGCCATCGCCCATCTCGGC
ATCTCCCGCATGGAGGACGCCCTTCGCATCACCCGCTTCCGCGACGGCAACGGCAACCCCAGCGAC
CCCAACTCCAGCTCGGTTGCCGTCTTCACCATCATGATCCAGGGCATTCCCAAGACGCTCGCCGCA
GACAAGACCCCGCTCAAGGATTACTTTGAGCACAAGTACCCTGGAAAGGTGTACCGGGTCATCGTG
CCCTTCGATCTCTGCACGCTGGAGTATCTAGCTGAGGAGTGGGGAAGGTGCGGAACAGGATTTCT
TGGCTGGAGGCAAGGATGGATGCCCGCAACCTATTTGATGAATTTGCTCAGGGTGGAAGACATTCA
GAAGAGCATTGGATTGTGAGGAGATGCAAAGAGCTGTGGGTGATGACAGCAGAGAGGTTCGGGTTT
ACTGACGAGGAAATGCTAAGGAGGTTGCAGACAAAGAAACTTGTCCTCGGTAGCAGGTTATCGGAT
```

```
TATAAGGATGGGCGTGCTCCCGGTGCTGGCATAGCCTTTGTGGTTTTTAAGGACGTGTATACAGCA
AACAAGGCTGTGAGAGATTTCCGGATGGAAAGGAAGAAGACACCAATAGGGAGGTTCTTCCCGGTG
ATGGAGCTCCAGCTTGAGAGAAGCCGTTGGACTGTGGAAAGGGCACCACCGGCATCAGATATCTAC
TGGAACCATCTAGGGCTGAGCAAGACCTCACTAGGATTGCGGCGTATTGCAGTCAACACCTGCCTC
ATTCTGATGCTCTTGTTCTTCAGTTCACCATTGGCAATAATTAGTGGGATGCAAAGTGCAGCGCGG
ATCATCAATGTGGAGGCTATGGATAACGCCAAATCATGGCTTGTCTGGCTCCAAAGCTCTAGCTGG
TTCTGGACCATTATCTTTCAGTTTCTTCCCAACGTCCTCATTTTTGTGAGCATGTATATTATCATC
CCATCAGTGCTGTCTTACTTCTCCAAGTTTGAGTGTCATCTGACAGTGTCGGGAGAGCAGAGGGCT
GCATTGTTGAAGATGGTTTGCTTCTTCCTTGTTAATCTCATTCTACTGCGTGCGCTGGTGGAATCA
TCGCTTGAAAGTTGGATACTCAGTATGGGCCGGTGCTACCTAGACAGTGTTGATTGCAAGCAGATT
GAACAATACTTAAGCCCCTCTTTTTGTCAAGATCTTCACTCTCCTCCCTGGCATTCTTGATCACA
TGCACCTTTCTAGGAATATCCTTTGATCTGTTGGCTCCAATCCCTTGGATAAAGCATGTAATGAAG
AAATTTAGAAAGAATGATATGGTCCAGTTGGTCCCTGAAGAAAATGAGGACTACCAACTGATGCAT
GATGGCGAAGAAACAAATAATTTGAGAGCGCCTCTAATGTCTGAGAGAGAAGACAGTGGCATTCTG
AATGGTATTGAGGAGCATGATCTTTCATTGTACCCGATAAACAGGAGCTTCCATATGCCAAAGCAG
ACATTTGACTTTGCACAATACTATGCATTTGACATTACAATATTCGCGCTCACAATGATCTACTCA
CTGTTTGCTCCTCTGACAGTTCCTGTCGGCGCAGTATACTTTGGCTACCGATACCTTGTGGACAAG
TACAATTTCCTGTTTATCTACAGAGTTAGAGGGTTTCCTGCAGGCAATGATGGGAAGCTGATGGAC
ATGGTGATCTGCATCATGCAATTCTGCGTTATTTTCTTCCTTGTTGCAATGTTACTATTCTTTGCA
GTCCAAGGTGATCCTATGAAGCTACAGGCAATATGTACTCTTAGTTTGTTAGTCTTTTATAAATTG
CTGCCCTCTAGAAGTGATCGCTTCCAGCCATCCTTGTTGGAAGGGATGCAGACAGTTAATAGCTTT
GTAGATGGTCCAACAGATTATGAAGTTTTTCACAACCTGACCTGGATTGGAGCCTGTATCAATCC
TGA
```

SEQ ID NO: 415, protein - Oryza sativa
```
MGPTAPPPDAGGGEPEAWYGSIQYLVNISAVGAASCVLLFLLVKLRFDHRRIPGPSALAAKLLAVY
HATAPQIALHCGADAAQFLLFERASFLVLAAVAAAAVAAALPLNLLAGDAAIADQFAATTISHIPK
SSPLLWLHLLLTAAVVAIAHLGISRMEDALRITRFRDGNGNPSDPNSSSVAVFTIMIQGIPKTLAA
DKTPLKDYFEHKYPGKVYRVIVPFDLCTLEYLAEEWGKVRNRISWLEARMDARNLFDEFAQGGRHS
EEHWIVRRCKELWVMTAERFGFTDEEMLRRLQTKKLVLGSRLSDYKDGRAPGAGIAFVVFKDVYTA
NKAVRDFRMERKKTPIGRFFPVMELQLERSRWTVERAPPASDIYWNHLGLSKTSLGLRRIAVNTCL
ILMLLFFSSPLAIISGMQSAARIINVEAMDNAKSWLVWLQSSSWFWTIIFQFLPNVLIFVSMYIII
PSVLSYFSKFECHLTVSGEQRAALLKMVCFFLVNLILLRALVESSLESWILSMGRCYLDSVDCKQI
EQYLSPSFLSRSSLSSLAFLITCTFLGISFDLLAPIPWIKHVMKKFRKNDMVQLVPEENEDYQLMH
DGEETNNLRAPLMSEREDSGILNGIEEHDLSLYPINRSFHMPKQTFDFAQYYAFDITIFALTMIYS
LFAPLTVPVGAVYFGYRYLVDKYNFLFIYRVRGFPAGNDGKLMDMVICIMQFCVIFFLVAMLLFFA
VQGDPMKLQAICTLSLLVFYKLLPSRSDRFQPSLLEGMQTVNSFVDGPTDYEVFSQPDLDWSLYQS
```

SEQ ID NO: 416, DNA - Oryza sativa
```
ATGAAAGTCGGCGCTCTTTTGACCTCAGCTGGAATCAACATTAGCCTCTGTATACTTTTTTTGTCA
CTGTATTCCGTTCTGAGGAAGCAACCGCAAAATGTTAAGGTCTATTTTGGAAGAAGGATTGCTGAG
GAGAATAGTAGGCTCAGGGAGGCTTTTATTTTGGAGAGATTTGTTCCATCCGCTAGCTGGATTTTG
AGAAGTCTTCGATGCACGGAGGATGAACTCTTAGCTACTGCTGGGTTGGATGCAGTTGTCTTCAAT
AGGATTCTTGTATTTAGCATACGCATATTCTCCTTAGCCGCTTTCCTTTGTGTACTTGGAGTTCTT
CCACTGAATTATTTTGGACAAGATATGCTCCATGTACGGATTCCTTCAGCATCATTGGAGACATTT
ACAATTGGAAATATGCAAGAGAGATCAAGATGGCTCTGGGTCCATTGTGTTGCACTGTACATCATA
TCTGGTGTGGCTTGCCTTCTTCTATACCTTGAGTACAAGCATATTGCTAGGCTGAGGTTACTTCAT
GTTTCTCGAGCATCGACCAATCCTAGCCATTTTACTGTGCTTGTTCGTGGAGTACCAAAATCAACT
```

FIGURE 24 (continued)

AAAGAATCAATTAGTTGCACTGTTGAGAGTTTCTTCACCAAGTATCATGTGTCGAGTTACCTTTCT
CATCAGATTATTTATAAAGTCGGGAAACTTCAGAAGATTGTGACTGGTGCAAAGAAGGCTTATAAG
AAATTTAAACATTTCAAGGGCACCACAGTTGATCAGAGATGCGGACCAATTACATATAGATGTGGT
CTTTGTGGAGCTTCATCAAAGTCGTTCGAGTTGCTGCCTGTTGAACCTGAGCAAGAGATGAAAAAA
CATGATGTGAAAGATTCAGAGTTGAGCTTACCTGATAAGGATTGTGGTGCTGCTTTTGTATTTTTC
AAAACTCGGTATGCAGCCCTGGTCGTATCAGAAATTGTTCAGACATCCAATCCTATGGAATGGGTT
ACTAGTCTTGCTCCAGATCGAGATGACGTATATTGGTCAAATCTTTGGTTACCCTACAAGCAGCTT
TGGATTCGCCGTATAGTTACACTTTCGGGTTCTATTGTTTTATGTTCCTGTTTCTCATACCTGTG
ACATTTATACAAGGTCTAACTCAGTTGGAGCAGCTGCAGCAAAGGCTCCCTTTCCTAAATGGCATA
TTAAAAAAGAAGTACATAACCCAGCTAGTGACCGGATACCTTCCCAGTGTCATCTTGCAAATATTT
TTATACACTGTTCCCCCAACCATGATGTTTTTTCTACATTAGAAGGACCCGTGTCCCACAGTGAA
AGGAAGAGAAGTGCCTGCTGTAAAGTATTATACTTCACTATTTGGAATGTATTCTTTGTGAATGTC
CTATCAGGTTCTGCAATTAGCCAAGTGAATGCGTTATCAAGCCCAAAGGACATTCCTATGGTGCTT
GCTAGAGCGGTACCTGTACAGGCTACATTCTTTACCACCTATGTACTGACTTCTGGTTGGGCTAGT
TTATCATCAGAACTTATGCAACTCTTTGGTCTCACATGGAACTTTATAATGAAGTATGTTTTGAGA
ATGAAAGAGGATAGCTACTTTGTCCCGTCATTTCCCTATCATACTGAAGTGCCAAAAGTTCTGTTG
TTTGGACTACTGGGATTCACATGCTCTGTATTAGCACCTCTCATCTTGCCCTTTTTACTGGTGTAC
TTTTTTCTTGGTTATGTTGTGTACCGCAACCAGTTCCTCAATGTTTATTGCACGAAATACGACACA
GGTGGTCTGTATTGGCCGATTGCTCACTATACAACAATCTTCTCTATTGTGCTCACCCAGATCATC
TGTCTTGGTGTCTTTGGGCTTAAAGAATCCCCAGTAGCTGCAGGCTTCACTGTACCTCTCATCATC
CTCACTCTTTTATTCAACCAGTATTGCAGCAATCGTCTTCGGCCATTATTCAAGACTCTCCCTGCA
CAGGATTTAATTGACATGGACAGGGAGGACGAGCAATCGGGAAGAATGGATGACATTCACCACCGT
CTTCATTCTGCTTACTGCCAGTTTGCTGACACTGACGACATACCTCTGAAAGGAGTTCACGTTGAC
AGAGATGCAGATGCAAGCGGAAGTTCCGGTGAATCTAGCTGCAAAGAAGACACCAACCAACCCACA
ACCAGTGACATTTCTCACCCTACACTGGAAGGACTCCCTGTAAACCGGCTACGGCATGCAGTGAGG
TCGCTCAGTTCCATCATCAGGTTACAGAAGAGAGGCCTGTCACCACAGCCCGCTGGACCCTCCGCC
GATGTAAATCCGCAAACTGCATAA

SEQ ID NO: 417, protein - Oryza sativa
MKVGALLTSAGINISLCILFLSLYSVLRKQPQNVKVYFGRRIAEENSRLREAFILERFVPSASWIL
RSLRCTEDELLATAGLDAVVFNRILVFSIRIFSLAAFLCVLGVLPLNYFGQDMLHVRIPSASLETF
TIGNMQERSRWLWVHCVALYIISGVACLLLYLEYKHIARLRLLHVSRASTNPSHFTVLRGVPKST
KESISCTVESFFTKYHVSSYLSHQIIYKVGKLQKIVTGAKKAYKKFKHFKGTTVDQRCGPITYRCG
LCGASSKSFELLPVEPEQEMKKHDVKDSELSLPDKDCGAAFVFFKTRYAALVVSEIVQTSNPMEWV
TSLAPDRDDVYWSNLWLPYKQLWIRRIVTLSGSIVFMFLFLIPVTFIQGLTQLEQLQQRLPFLNGI
LKKKYITQLVTGYLPSVILQIFLYTVPPTMMFFSTLEGPVSHSERKRSACCKVLYFTIWNVFFVNV
LSGSAISQVNALSSPKDIPMVLARAVPVQATFFTTYVLTSGWASLSSELMQLFGLTWNFIMKYVLR
MKEDSYFVPSFPYHTEVPKVLLFGLLGFTCSVLAPLILPFLLVYFFLGYVVYRNQFLNVYCTKYDT
GGLYWPIAHYTTIFSIVLTQIICLGVFGLKESPVAAGFTVPLIILTLLFNQYCSNRLRPLFKTLPA
QDLIDMDREDEQSGRMDDIHHRLHSAYCQFADTDDIPLKGVHVDRDADASGSSGESSCKEDTNQPT
TSDISHPTLEGLPVNRLRHAVRSLSSIIRLQKRGLSPQPAGPSADVNPQTA

SEQ ID NO: 418, DNA - Oryza sativa
ATGGAATTTTCTGCCCTTCTGACTTCGGCAGGCATAAACATCGGCCTCTGTGCGCTCTTCCTGTCA
CTCTATTCAGTCCTTAGGAAGCAGCCTCACAACTATGGCGTCTACTTCGGGAGGCGGCTCGCCGAG
GAGAAGTTCCGGCAGCAGGTCGACTACTTCTCGCTTGAGAGGCTCTTGCCTACCGCTGGATGGATA
GTGAAAGCGTACTGGTGCACGGAAGAGGAGATACGACGGGTTGCTGGCTTGGATTCCGTGGTGTTC
CTCCGCCTCTTCATCTTCAGCATACGTATCTTCTCGATAACTTCTCTTGTTTGCATATTTGGAGTG

FIGURE 24 (continued)

```
CTTCCTGTTAATTACCATGGGAAAGAAACGAATCACGGACGTATTCCAGCAGAGTCTCTCAATGTA
TTCACAATTGCAAATCTCAAAGAAGGATCACGAATGCTTTGGGTGCATTGTGTTGCCTTATATGTT
ATAACAATATCAGCTTGTATTCTTCTATACTATGAGTATAAGTATATATCAAGGAAGAGATTGGCG
CATATTACTGGATCACCACCTGGTCCGGGTCATTTTTCTGTGATTGTTCGATCAATACCAAAGTCA
GATAATGAGCTACTTGATGACACTATCAGAAATTTCTTTGTTAATTATCATGGATCCAGTTACTTG
TCACATCAGATGATCTACCGGAAAGGAAGTATGCAGAAATTTGTGGATAATGCAGAGAGGGTATAT
AGGAAATTTGTAAGAGTTAAGATGTCTTCATTTGGACAGAGTAGAAGGTCTGACTTGTCCAGATGT
GGTCTTTGTGGAGTACGGGCTTCGTCGTTTCAGCAATATCGCAATAAATTCATCAATTCCAAGAAG
CCAGACCTAAGTGATCCAGAAGTAATTGAAGCTCAGAAGGATTGTCCAGGTGCTATAGTATTCTTC
AAGACTCGCTATGCGGCAATTGTTGCTTCACGAATTCTTCAATCTTCAAATCCTATGCTATGGGTG
ACAGATTTTGCTCCTGAGCCAAGGGATGTCTATTGGTCAAACCTCTGGATCCCCTATAGACAGATC
TGGCTCCGGAAAATAGCAACACTTGCAGCTAGTGTTGCCTTCATGTTTGTTTTATTGTCCCCGTT
GCATTCGTCCAAAGCATGATGCAACTGGATCAGATTGAGCAGCTATTTCCAAGCCTGAAAAACATG
TTGAAGAAGCCCTTTTTTGTCAAACTTGTAACGGGATACCTCCCTAGCGTCGTTCTGCTGCTGTCC
CTGTACACAGTTCCTCCATTGATGATGTTCTTCTCTTCCATAGAAGGATCGATTTCTCGCAGTGGC
AGGAAAAAAAGTGCTTGCTGCAAAATTTTGTTCTTTACCATCTGGAACGTCTTCTTTGTCAATGTC
CTGTCAGGATCCGTGCTAAATCAGCTAAATGTCTTCACTAGACCAAGGGATATGCCATCTATGCTT
GCCGAACTTGTACCAAAGCAGGCAACTTTCTTCATCACTTATGTCCTCACATCAGGATGGGCAAGT
CTATGCTCCGAGATATTGCAAGTGTACAACTTAGTATATAACTTCTTCAGAAAATGTATATTTGC
TACCGGGATGATCCAGAATATGGCTACTCTTTCCCTTACCATACTGAAGTCCCGAAAGTCCTCCTG
TTCAACCTGCTTGGCTTCACATTTTCGATAATGGCACCTCTCATACTGCCCTTCTTGCTAGTCTAC
TTTTGCCTCGGCTACCTAGTGTATCGCAATCAGATCCTAAATGTCTACTACCCAAAGTACGAAATG
GGAGGGAAACTGTGGCCAATCATGCACAGCACCTTGGTTTTCGCCCTGGTTTTGACACAGACCATA
GCTCTTGGAGTGTTCACCATAAAGCACGCTACTATATCTTCAGGGTTCACCGTCCTACTAATCATC
GGGACAGTCCTCTTCCATCAGTATTGCAGACACCGGTTTTCAAGCATATTCAACTCCTTTTCTGCC
CAGGATCTGATAGAGATGGACAGAGACGATGAACAATCCGGGAGGATGGAGGAGATCCACAAGCAC
CTTCTGGACGCCTACTCCCAAGGCACCACCAACATGGACAACTCCAGTTCTTCCAGGAATGGAGGG
GCTCCAATCGAAATGATCATGGAAGACCCTGCGCAGGATGCACAGGATTCTAACCAAGAACTCTGT
GACGCCGTGAAGGAAGTGACTGGGTCGATTCAGGAACATGCCGACGAGATGTGA
```

SEQ ID NO: 419, protein - Oryza sativa
MEFSALLTSAGINIGLCALFLSLYSVLRKQPHNYGVYFGRRLAEEKFRQQVDYFSLERLLPTAGWI
VKAYWCTEEEIRRVAGLDSVVFLRLFIFSIRIFSITSLVCIFGVLPVNYHGKETNHGRIPAESLNV
FTIANLKEGSRMLWVHCVALYVITISACILLYYEYKYISRKRLAHITGSPPGPGHFSVIVRSIPKS
DNELLDDTIRNFFVNYHGSSYLSHQMIYRKGSMQKFVDNAERVYRKFVRVKMSSFGQSRRSDLSRC
GLCGVRASSFQQYRNKFINSKKPDLSDPEVIEAQKDCPGAIVFFKTRYAAIVASRILQSSNPMLWV
TDFAPEPRDVYWSNLWIPYRQIWLRKIATLAASVAFMFVFIVPVAFVQSMMQLDQIEQLFPSLKNM
LKKPFFVKLVTGYLPSVVLLLSLYTVPPLMMFFSSIEGSISRSGRKKSACCKILFFTIWNVFFVNV
LSGSVLNQLNVFTRPRDMPSMLAELVPKQATFFITYVLTSGWASLCSEILQVYNLVYNFFRKCIFC
YRDDPEYGYSFPYHTEVPKVLLFNLLGFTFSIMAPLILPFLLVYFCLGYLVYRNQILNVYYPKYEM
GGKLWPIMHSTLVFALVLTQTIALGVFTIKHATISSGFTVLLIIGTVLFHQYCRHRFSSIFNSFSA
QDLIEMDRDDEQSGRMEEIHKHLLDAYSQGTTNMDNSSSSRNGGAPIEMIMEDPAQDAQDSNQELC
DAVKEVTGSIQEHADEM

SEQ ID NO: 420, DNA - Oryza sativa
```
ATGGGTTCTCTCACAGATATCGGCGTCGCCGCAGGAATAAACATACTGTCCGCATTGGGTTTTCTT
CTCGCATTTGCGGTTCTCAGGATACAGCCTATCAACGACAGGGTCTACTTTCCCAAATGGTACCTC
AAAGGGACAAGAAGCAGCCCAAGAAGCATGGGAACGGTTTTCTCAAAGTTTGTCAATGCTGATCTC
```

FIGURE 24 (continued)

```
TCGACGTATATCCGCTTCCTGAATTGGATGCCTGCAGCGCTGCAAATGCCTGAGCCCGAGTTGATT
GAGCACGCAGGCCTCGACTCCGCGGTATATGTCCGCATATATCTTCTTGGGTTAAAAATATTTGTG
CCGATTGCTGTGCTGGCATTCATTGTCCTTGTTCCTATCAACTGGGCTAGTGGAACTTTGGAGAAG
GAAAAGAGTCTAAGTTATGATCAAATTGACAAGCTTTCAATATCTAACCTTGGAAAAGGATCGAAA
AGATTTTGGGCACACATAGTGATGGCCTATGTATTTACGTTTTGGACGTTTTTCGTGTTGTATCGT
GAATACAAGGTTGTAACAACTATGAGATTGCGCTTTCTTGCTATTCAGAATCGTCGAGCTGATCAG
TTTACGGTCCTGGTGAGAAATGTACCACCTGACCCAGATGAAACAGTTAGTGAGCATGTTGAGCAC
TTCTTTGCTGTCAATCATCGTGATCATTATCTCAGTCACCAGACCGTATACAATGCAAACACCCTT
GCCGGTTTGGTTGAGCAGAAGAAAGGCTTGCAAAACTGGCTGGTCTACTACGAAAACCAGCATGCT
AAAAACCCTGCAAAAAAACCAACTATGAAGACAGGATTGTGGGGCCTTTGGGGAAAAGAGTGGAT
GCTATAGAACACTACACCACTGCCATTGAGGAGTTATGCAAACAGGAAGATGAGGAGAGACACAAG
GTGATCACTGATCCTAATGCTATTATGCCAGCTGCATTTGTATCTTTCAAAAGCCGGTGGGGAGCT
GCTGTTTGCGCTCAAACGCAACAGACGAGCAATCCAACGTTGTGGCTTACCGAGTGGGCCCCAGAA
CCTCGGGATGTTTTCTGGCCTAATCTCGCGATCCCTTTCGTCGAGCTCTCAGTCCGGAGGCTTATC
ATGGCCGTTGCACTCTTCTTTCTGACCTTTTTCTTCATGATTCCAATTGCAATTGTCCAATCAATG
GCAAACTTGGATGACATTGAACGGATGCTTCCTTTCCTGAAACCTATAATAGAAAGAAATTCACTG
AAGTCAATTGTGCAAGGTTTCTTGCCAGGAATCGCATTGAAAATCTTCCTTATACTTCTCCCAACA
TTCTTGTGATGATGAGCAAAATTGAAGGTCATACATCACTATCTGGATTGGACAGGAGGACTGCG
TCGAAGTATTATTTGTTCCTATTTGTCAATGTGTTCTTGGGGAGTGTAATAACTGGAACAGCGTTC
CAACAACTCAACAATTTTATCCATCAGTCAGCTAATAAAATTCCAGAGATTGTCGGAGAATCCATC
CCCATGAAAGCAACATTTTTCATCACATATGTAATGGTTGATGGCTGGGCTGGTGTTGCCGCTGAG
GTTCTTAGGTTGAAGCCATTGGTCATGTTCCATATAAAGAATACTTTCTTGGTCAGAACCGAGCGA
GATCGAGAGCAGGCCATGGACCCTGGGAGCCTGGATTTTGGCACCACAGAACCAAGGATACAACTG
TACTTTCTGCTTGGGCTTGTATATGCTGTCGTGACACCAATTCTTCTACCTTTCATCATAGTGTTC
TTTAGCCTTGCCTATCTAGTATTCAGACACCAGATCATTAATGTCTACAATCAGCAATATGAGAGT
GGCGCGCAATTCTGGCCAGATGTCCAAAGACGACTGGTTATAGCATTGATAGTATCACAAATCCTC
CTGTTGGGACTGCTGAGCACGCAGGAAGCAGAGAAATCCACTGTTGCTCTTCTTCCTCTTCCTGTA
CTGTCCATATGGTTCCACTATGTTTGCAAGGGCCGCTTTGAGCCAGCGTTTATAAAGTTCCCCCTG
CAGGATGCAATGGTAAAGGATACACTGGAACGGGCAAATGACCCAACCCTGAATTTGAGAGAGTAC
CTGAAGGATGCATATGTGCACCCAGTGTTCCAAAAAAATGACATATATGAGTTTGCTGGCATCGAC
GAGGAAGAGAAGAACCCCATGGTTGCAACGAAGCGCCAATCGCGAATGAACACACCAGTAGATAGC
AAGTTCAATTCCAGTTCTGGCACTAATGAAGGAGAGTTCAGTCGGATGGCTCCTACCTGA
```

SEQ ID NO: 421, protein - Oryza sativa
```
MGSLTDIGVAAGINILSALGFLLAFAVLRIQPINDRVYFPKWYLKGTRSSPRSMGTVFSKFVNADL
STYIRFLNWMPAALQMPEPELIEHAGLDSAVYVRIYLLGLKIFVPIAVLAFIVLVPINWASGTLEK
EKSLSYDQIDKLSISNLGKGSKRFWAHIVMAYVFTFWTFFVLYREYKVVTTMRLRFLAIQNRRADQ
FTVLVRNVPPDPDETVSEHVEHFFAVNHRDHYLSHQTVYNANTLAGLVEQKKGLQNWLVYYENQHA
KNPAKKPTMKTGLWGLWGKRVDAIEHYTTAIEELCKQEDEERHKVITDPNAIMPAAFVSFKSRWGA
AVCAQTQQTSNPTLWLTEWAPEPRDVFWPNLAIPFVELSVRRLIMAVALFFLTFFFMIPIAIVQSM
ANLDDIERMLPFLKPIIERNSLKSIVQGFLPGIALKIFLILLPTFLVMMSKIEGHTSLSGLDRRTA
SKYYLFLFVNVFLGSVITGTAFQQLNNFIHQSANKIPEIVGESIPMKATFFITYVMVDGWAGVAAE
VLRLKPLVMFHIKNTFLVRTERDREQAMDPGSLDFGTTEPRIQLYFLLGLVYAVVTPILLPFIIVF
FSLAYLVFRHQIINVYNQQYESGAQFWPDVQRRLVIALIVSQILLLGLLSTQEAEKSTVALLPLPV
LSIWFHYVCKGRFEPAFIKFPLQDAMVKDTLERANDPTLNLREYLKDAYVHPVFQKNDIYEFAGID
EEEKNPMVATKRQSRMNTPVDSKFNSSSGTNEGEFSRMAPT
```

FIGURE 24 (continued)

SEQ ID NO: 422, DNA - Oryza sativa
ATGGCCACTGTTTCTGACATCGGCCTCTCCGCGGCTATCAACGTCTCGATGGCCGTTGCATTCTTG
CTGGTCTTTGCTTTTCTACGATTACAGCCCATCAACGATAGGGTTTACTTTCCAAAATGGTACCTC
AGAGGAATGAGAGACAGCCCTGTTTCCTCTGGTGCTGCAGTGCAAAAGGTTGTCAATTTAAACATG
AGATCATACTTGAAATTTTTAAGTTGGATGCCGGCTGCTCTCAAGATGCCAGAGGATGAGTTGATC
AATCATGCAGGCCTTGATTCCGCTGTCTATCTACGGATATACCTAACAGGGATCAAGATATTCGTT
CCAATATCAATTTTAGCTTCGCTTGTTCTGTTCCCTGTGAACTGGACAAATGACACCCTAGACAGC
ATGAAGGTAGTCCACAGTAAAATTGACAAACTTTCAATATCAAACATACCTTATGGGTCAAACAGG
TTTGTTACTCACTTGGTTATGGCTTATGCTGTCACGTTTTGGACCTGCTATGTACTGTTCCGAGAG
TATGAGATAATTACAACGATGAGATTGCGGTTTCTTGCTTCAGAGAAACGGCGACCAGACCAGTTT
ACAGTTCTTGTGCGGAATATACCTCCAGATCCTGATGAATCAATTAGTGAGCTCGTGGAGCATTTC
TTCCTTGTTAATCATCCTGATCATTATCTAAGACACCAGGTGGTTTACAATGCAAATAAACTTGCT
GATCTGGTTGAGAAGAAGAAGAAACTGCAAAATTGGCTTGATTACTACCAGCTCAAGTATGAAAGA
AATCCATCAAAAAGGCCCACCACTAAGACTGGCTTTCTTGGCTGTTTTGGTTCCGAGGTGGATGCC
ATTGAATACTACAAAGCAGAGATTGAGAAGATTGGGAAAGAAGAAGCTGATGAGCGTCAAAAGATC
ATGAAGGATCCCCAGTCAGCTGTTCCAGCAGCCTTTGTTTCATTTCGTTCACGGTGGGGGCTGCT
GTTTGTGCTCAGACACAGCAAACCAGTAATCCAACAGTCTGGATAACTGAATGGGCTCCAGAACCT
CGTGATGTCTACTGGAATAATCTATCCATTCCATTTGTGTCCCTCACAGTTAGGAGGCTGATAGTT
GCTGTGGCATTCTTCTTCCTCAACTTTTTTTATGTCATTCCAATAGCATTCGTGCAATCTCTTGCA
AGCCTTGAAGGAATAGAAAAGGCGCTTCCATTTCTGAAACCCTTAATCAAAATTGATGTCATCAAA
TCATTCATCCAAGGTTTTCTTCCAGGAATTGCTTTGAAGGTCTTCCTTATATTGCTTCCAACTATA
CTGATGTTTATGTCTAAGTTTGAAGGATTAATATCACAGTCATCACTGGAGCGAAGATCTGCATCT
AAATATTATATCTTCTTGTTCTTCAATGTATTTTTGGGAAGCATCGTTACAGGATCTGCTTTAGAT
CAGCTTAAGGCATACATTCATCAGTCGGCAAATGAAATACCGAGAACCATCGGTGTAGCCATTCCA
ATGAGGGCGACTTTTTTCATAACATATGTAATGGTTGACGGTTGGACTGGTGTAGCTGGTGAAATA
TTGAGATTGAGGGCACTTATAATCTTCCATTTGAAAAACTTTTTCTTGGTGAAGACTGAAAAGGAC
AGAGAAGAGGCAATGGATCCTGGTAGTATCTGTTTTGATTGGTGTGAACCACGTATACAGCTATAT
TTCTTACTTGGCCTTGTCTATGCTGTGGTGACACCGTTATTGCTTCCTTTCATATTGGTATTCTTC
GGGCTGGCATATGTTGTCTACCGCCACCAGATAATAAATGTCTACAATCAACAATACGAGAGTGGT
GCACAGTTTTGGCCGAGTGTGCACGGGCGCATAATCATTGCATTGATCGTATCACAGCTACTTCTT
ATTGGACTGTTGAGTACAAAAGGTTTCGAGGAGACGACACCAGTTCTTGTTGTTCTTCCTGTGTTG
ACGTTTTGGTTTTACAAGTACTGCAAGAACCGGTTTGAGCCTGCATTTGTGAGGAACCCACTACAG
GAAGCGATGAGGAAAGACACCCTGGAACGGGCAAGGGAGCCAACCTTCGATCTGAAAGCGTACCTG
GCCAATGCGTACCTGCACCCGGTGTTCAAAGGCAGGGAGGAGGAGGACAATATGTCAATATCCGAG
GATGTCGGGATGGAGGAGGTGATCGTGCCGACCAAGCGTCAATCTCGCCGGAACACTCCCGCCCAG
AGCAAGTACGAAGGCTCCGACACGCTCTCTCTTCCTGAAACTGTACACGAACGATAG

SEQ ID NO: 423, protein - Oryza sativa
MATVSDIGLSAAINVSMAVAFLLVFAFLRLQPINDRVYFPKWYLRGMRDSPVSSGAAVQKVVNLNM
RSYLKFLSWMPAALKMPEDELINHAGLDSAVYLRIYLTGIKIFVPISILASLVLFPVNWTNDTLDS
MKVVHSKIDKLSISNIPYGSNRFVTHLVMAYAVTFWTCYVLFREYEIITTMRLRFLASEKRRPDQF
TVLVRNIPPDPDESISELVEHFFLVNHPDHYLRHQVVYNANKLADLVEKKKKLQNWLDYYQLKYER
NPSKRPTTKTGFLGCFGSEVDAIEYYKAEIEKIGKEEADERQKIMKDPQSAVPAAFVSFRSRWGAA
VCAQTQQTSNPTVWITEWAPEPRDVYWNNLSIPFVSLTVRRLIVAVAFFFLNFFYVIPIAFVQSLA
SLEGIEKALPFLKPLIKIDVIKSFIQGFLPGIALKVFLILLPTILMFMSKFEGLISQSSLERRSAS
KYYIFLFFNVFLGSIVTGSALDQLKAYIHQSANEIPRTIGVAIPMRATFFITYVMVDGWTGVAGEI
LRLRALIIFHLKNFFLVKTEKDREEAMDPGSICFDWCEPRIQLYFLLGLVYAVVTPLLLPFILVFF
GLAYVVYRHQIINVYNQQYESGAQFWPSVHGRIIALIVSQLLLIGLLSTKGFEETTPVLVVLPVL
TFWFYKYCKNRFEPAFVRNPLQEAMRKDTLERAREPTFDLKAYLANAYLHPVFKGREEEDNMSISE
DVGMEEVIVPTKRQSRRNTPAQSKYEGSDTLSLPETVHER FIGURE 24 (continued)

SEQ ID NO: 424, DNA - Oryza sativa
ATGGACACCGCGTCGTTCGTGACGTCGCTGCTGACGTCGTTCGTGATCTTCGTCGTGCTGGTGCTG
GTGTTCACGTGGCTGTCGAGCAGGCCGGGCAATGCGCCGGTGTACTACCCGAGCGTCCTGCTGCGG
GGGCTCGACCCGTGGGAGGGCGGGGGCGGGGGACGAGGAGCCCCGTCGGGTGGCTGCGCCAGGCG
ATCTCCGCCTCGGAGGGTGACGTCGTCGCCGCCGGCGGGGTCGACGCCGCCGTCTACCTCGTCTTC
CTCTCCTCCGTGTTGTCCATCTTGGTGTTCTCTGGGATTGTGCTGCTTCCAGTTCTGCTACCTGTT
GCTGCTACTGACGATAACCTGAACCTGGAAAGGGCTATTGGCCTGAAGAATGGCAAAACACCCCAG
AACTTCACAGAGCTCGAGAAATTAGCACTGGGCAATGTTCAAGAACATAGCCGAAGGCTGTGGGCA
TTTCTATTATCAGTCTATTGGGTCTCTTTTGTCACGTACTTCGTACTATGGAAGTCCTACAAGCAT
GTTTCTAATATGAGAGCGGCTGCAAGATCAACACCAGATGTTAAACCGGAGGAGTTTGCTGTGTTG
GTGAGAGATGTTCCTAAGCCACCTCCTGATCAAACTATAAAGGATTCTGTAGACTCATATTTCCGA
GCACTTCATCCTGATACCTTCTACAGATCAATGGTTGTGACTGACCACACAAAGGCTGACAAAATT
TATCAAGAGATTGAAGGTCACAAACAGAAAATTGCTCGTGCTGAAGTTGTCTATGCGGAGTCTAAA
ACAACAGGCAAGCCTGAGGGCACCAAGCCTACGCATCGGATTGGATTTCTTGGTCTTATCGGTAAA
AAGGTTGATACAATTGAGTATTGTAATGACCAAATCAAGGAGTTGCTGCCCAAACTGGAGGCCGAA
CAGAAGACTACCCTTCGTGAGAAACAGCAACAGGCTGCAATTGTGTTTTCAACAGAAGATCTGCT
GCAGCTTCTGCATCTCAGACTCTCCATGCTCAGATGTTTGATAAATGGACTGTTGAGCAGGCTCCT
GAACCACGCCAGATAATATGGTCTAATCTTTCCAAGAAAATATATGAGAGGCAAATCAGACAGGTT
GTGGTCTATACCATTGTCTTTCTCACAGTGGTTTTCTATATGATTCCTATTACTGCTATCTCTGCT
CTTACAACTTTGGAGAAGTTGAGGGAGAAGCTTCCCTTTCTGAAGGTGGTGGTGGACCAACCGAAA
ATCAAGACTGTCCTACAGGCTTACCTCCCGCAGCTTGCACTTATTGTTTTCCTTGCTTTGCTGCCT
AGTCTTCTAATGTTCCTCTCAAAGCTGGAGGGGATTCCTTCACAGGGTCATACAGTTAGGGCAGCA
GCAGGGAAGTACTTCTACTTCATTGTGTTCAATGTCTTCCTTGGGGTTACTATTAGTTCCACATTG
TTCAGTGCTTTGACAACCATAATCAATAACCCTCCTGGGATTGTGAACATGCTTGCCAGCAGCCTT
CCAGGAAGTGCAACTTTCTTCCTTACATTTGTTGCACTGAAATTCTTTGTTGGTTATGGGCTTGAG
CTCTCTCGCTTGGTCCCTCTTATCATTTTCCACCTGAAGAGGAAGTACCTATGCAAGACCGAGGAT
GAAGTGAGAGCAGCTTGGGCTCCAGGCGACCTAGGATATAACACCAGGGTTCCGAATGACATGCTC
ATAGTTACAATAGTGCTGTGCTACTCTGTCATTGCACCTCTGATTATTCCATTTGGTGTTGCTTAC
TTTGCTCTTGGATGGATTATAGTGAAAAATCAGGTTCTCCGAGTTTATGTTCCCAGCTACGAGAGC
AACGGGCGAATGTGGCCACATATGCACACAAGGATCATTGCAGCTCTACTGATTTACCAGATCACC
ATGGTTGGTGTCATCCTGCTGAAGAAGTTCTTGTACTCCCCTGTTCTTGTGCCCCTCATCCCAATA
AGCTTCATCTTCGCCTACATTTGCCATATGCGGTTCTACCCGGCGTTCGCCAAGACCCCTCTCGAG
GTGGTTCAGCACAACGTGAAAGACACGCCGAACATGGATGCCGTCTACACCTCCTACATCCCGGCT
TGCCTGAAGCCTGAGAAGCTAGAGGATGTGGATATCTTCGAAGACGCCCAGTTGCACACCACCTCC
AGAGCCCCATCCATCTAA

SEQ ID NO: 425, protein - Oryza sativa
MDTASFVTSLLTSFVIFVVLVLVFTWLSSRPGNAPVYYPSVLLRGLDPWEGRGRGTRSPVGWLRQA
ISASEGDVVAAGGVDAAVYLVFLSSVLSILVFSGIVLLPVLLPVAATDDNLNLERAIGLKNGKTPQ
NFTELEKLALGNVQEHSRRLWAFLLSVYWVSFVTYFVLWKSYKHVSNMRAAARSTPDVKPEEFAVL
VRDVPKPPPDQTIKDSVDSYFRALHPDTFYRSMVVTDHTKADKIYQEIEGHKQKIARAEVVYAESK
TTGKPEGTKPTHRIGFLGLIGKKVDTIEYCNDQIKELLPKLEAEQKTTLREKQQQAAIVFFNRRSA
AASASQTLHAQMFDKWTVEQAPEPRQIIWSNLSKKIYERQIRQVVVYTIVFLTVVFYMIPITAI**SA
LT**TLEKLREKLPFLKVVVDQPKIKTVLQAYLPQLALIVFLALLPSLLMFLSKLEGIPSQGHTVRAA
AGKYFYFIVFNVFLGVTISSTLFSALTTIINNPPGIVNMLASSLPGSATFFLTFVALKFFVGYGLE
LSRLVPLIIFHLKRKYLCKTEDEVRAAWAPGDLGYNTRVPNDMLIVTIVLCYSVIAPLIIPFGVAY
FALGWIIVKNQVLRVYVPSYESNGRMWPHMHTRIIAALLIYQITMVGVILLKKFLYSPVLVPLIPI
SFIFAYICHMRFYPAFAKTPLEVVQHNVKDTPNMDAVYTSYIPACLKPEKLEDVDIFEDAQLHTTS
RAPSI

FIGURE 24 (continued)

SEQ ID NO: 426, DNA - Oryza sativa
ATGGCGACGCTGCCGGACCTGGGTGTGTCCGCCTTCATCAACATCTTGGGCGCCTTCGTCTTCCTC
CTCATCTTCGCCGCCCTCCGCCTCCAGCCCATCAACGACCGCGTCTACTTCCCCAAGCTCTACCTC
ACTGGCCAGCGACGCCACCACCCTCACCCTCATGGCTTCGTCAACCTCGACCTCTGCTCCTACCTC
CGCTTCCTCGCCTGGGTCCCCGGCGCCCTCCGCATGTCCCAGCCCGACCTCATCCACCACGCCGGC
CTCGACTCCGCCGTCTACCTCCGAATCTACACGCTCGGCCTCAAGATATTTTGCCCATCATGACT
GTCGCCTTGCTGGTCTTATTCCAGTTAATGTCTCTGGTGGCACGTTACTTAATTTACGAAAAGAA
ATTGTCTTTAGTGATATTGATAAGCTTTCCATATCAAATGTCAACCCTGGATCCAACAGGTTCTTT
ATCCATCTATTAATGGCATATGTGTTCACTTTTGGACTTGCTTTATGCTATACAAAGAGTATAGC
AATGTGGCATTTATGAGATTGCACTTCCTGGCTTCTCAGAAGCGTTGTGCTGATCAGTTCACTGTG
ATTGTTAGAAACATACCTCATGTTTCAAGCCATTCAACATCTGAAACAGTGGATGAATTCTTCCGT
AGGAATCATCCAGACCACTATCTTGGTCAGCAGGCTGTTTATAACGCAAACAGGTATGCTAAACTT
GTGAAGAAAAAGAGAGGCTTCAAAACTGGTTGGATTACTACCAGCTGAAGTTTGAAAGGCATCCT
GGAAAAAGACCAATTGGAAGGACAGGGTGCCTTGGTTTCTGCGGTAGAGAAGTGGATCAAATCGAC
TATTACCGTGCTAGAATCAGCGAGCTTGATAAGAAGCTTGCATCTGAGCGTCAAAGAGTTCTCAAT
GACCCAAAAGCTGTTATGCCAGTTGCTTTTGTGACATTTGACTCGAGATGGGGAGCTGCTGTATGT
GCACAGACACAACAGTCAAAGAATCCTACCCAATGGCTAACTGATTGGGCTCCTGAACCGCGGGAT
GTATATTGGCAGAATCTTGCCATTCCATTTTTCTCTCAGTATCCGCAAGTTCCTGATATCCATT
GCAGTTTTTGCTCTGGTGTTCTTCTACATGATACCTATAGCTTTTGTGCAATCACTTGCCAATCTT
GAGGGTATTGAAAAAGTTGCACCTTTCCTAAGGCCTGTGATAGACACACCAGTGGTGAAATCCTTC
CTGCAGGGTTTCCTTCCGGGTTTGGCTTTGAAGATTTTTCTGTATATCCTCCCAACGGTTTTGATG
ATTATGTCAAAGGTTGAAGGTTATGTGTCTTTATCATCTCTGGAAAGGAGGGCTGCTTCAAAATAT
TACTACTTCATGCTGGTGAATGTATTTCTTGGAAGCATAATCGCTGGCACAGCTTTTGAACAGCTA
AATGCATTTTTCCATCAGCCACCTTCACAAATACCAAGGACCATTGGAGTAGCTATACCAATGAAA
GCTACATTTTTTATGACATACATAATGGTTGACGGGTGGGCTGGCATCGCGAACGAGATTCTTCGA
GTGAAGCCGCTGGTGATATACCACCTGAAGAACATGTTTATTGTGAAGACGGAGCGGGACAGGGAG
AGGGCAATGGATCCGGGCAGCATTGGGCTTGCAGAGAACCTCCCATCACTGCAGCTGTATTTTCTT
CTTGGGCTTGTGTATGCTGTGGTCACCCCCATTCTCCTCCCTTTCATTATCATCTTCTTTGCCTTC
GCTTTCCTCGTGTACAGACACCAGATCATCAACGTGTACAACCAAGAATACGAGAGTGCTGCTGCG
TTTTGGCCTCAGGTGCACTCTCGCATAATAGCGAGCTTGCTGATCTCGCATGTAACTCTGTTTGGG
CTGATGAGCACCATGAAGGCTGCCTACTCCACCCCGCTGCTTATCTTTCTGCCACTCCTCACCATA
TGGTTCCACAAGTACTGCAAGAGCCGTTTCGAGCCTGCTTTCCGCAAGTACCCTCTAGAGGAAGCG
ATGGAGAAGGACAATCTGGAGCGCACGTCGGAGCCAAACCTGAACCTCAAATCGTACCTGCAGAAC
GCTTACCTGCACCCCATTTTCCACATGTTTGAGCAGCAGCAGCAGCAGGAGCAGGAGCAGCAACGG
GAGGAGAAGGTAGAGGTGCGAATCGACAAGGCGCAGCAACATCATCATCGGCAGGTAGAGGAGGAA
GAGGAGGAGAGCAAGAGCAGCCAGGCTACAACACACTACTACCACCATCACCATGAGCAGACCACA
ACGACGACACACCACCATTACCATCAGCATGAGCATATGAGCCACTACCACATGGGCCCCTCCGAC
ACAGCTGACTCACCCTCGCCGCCGCACTTTGTCTACCATTATGGCGTCGACCCTTGA

SEQ ID NO: 427, protein - Oryza sativa
MATLPDLGVSAFINILGAFVFLLIFAALRLQPINDRVYFPKLYLTGQRRHHPHPHGFVNLDLCSYL
RFLAWVPGALRMSQPDLIHHAGLDSAVYLRIYTLGLKIFLPIMTVALLVLIPVNVSGGTLLNLRKE
IVFSDIDKLSISNVNPGSNRFFIHLLMAYVFTFWTCFMLYKEYSNVAFMRLHFLASQKRCADQFTV
IVRNIPHVSSHSTSETVDEFFRRNHPDHYLGQQAVYNANRYAKLVKKKERLQNWLDYYQLKFERHP
GKRPIGRTGCLGFCGREVDQIDYYRARISELDKKLASERQRVLNDPKAVMPVAFVTFDSRWGAAVC
AQTQQSKNPTQWLTDWAPEPRDVYWQNLAIPFFSLSIRKFLISIAVFALVFFYMIPIAFVQSLANL
EGIEKVAPFLRPVIDTPVVKSFLQGFLPGLALKIFLYILPTVLMIMSKVEGYVSLSSLERRAASKY
YYFMLVNVFLGSIIAGTAFEQLNAFFHQPPSQIPRTIGVAIPMKATFFMTYIMVDGWAGIANEILR VKPLVIYHLKNMFIVKTERDRERAMDPGSIGLAENLPSLQLYFLLGLVYAVVTPILLPFIIIFFAF
AFLVYRHQIINVYNQEYESAAAFWPQVHSRIIASLLISHVTLFGLMSTMKAAYSTPLLIFLPLLTI
WFHKYCKSRFEPAFRKYPLEEAMEKDNLERTSEPNLNLKSYLQNAYLHPIFHMFEQQQQQEQEQQR
EEKVEVRIDKAQQHHHRQVEEEEESKSSQATTHYYHHHEQTTTTTHHHYHQHEHMSHYHMGPSD
TADSPSPPHFVYHYGVDP

SEQ ID NO: 428, DNA - Oryza sativa
ATGATTCTGTCGGCGCTCGCGACTTCGGTGGGGATCAACCTGGGGCTGACGGTGCTCCTCGCGGCG
GCGTACACGCTGCTCCGGCGGCGCCCGCCGTACGTCGCCGTGTACTCGCCGCGGCGGCCGTACGCG
CCGCCGGAGCCGTGGCTGCCCGCGGCGTGGCGCCGCACCGAGGCCGACGTCCACGCCGCCGCCGGG
CTCGACGGCGTCGTCTTCCTCCGCATCTTCGTCTTCAGCATTAGGGTGTTCGCGGCGGCGGCGGTG
GTGGGGGTGGGAGTGCTGATGCCGGTGAACTTCATGGGGGACCAGCTGCGGCAGATTGACTTCTCC
GATCTGCCCAACAAGTCCGTCGATCTCTTCAGCGTCTCCAACGTGCAGGATGGCTCCAACAAATTG
TGGCTCCACTTTTCGGCTGTGTACATCATAACTGGAATTACATGCTACCTCCTTTATTATGAATAC
AAATATATTTCTGGCAAGAGGCTCGAATATTTTATGACATCAAAACCACTACCTCAGCATTTCACA
GTTCTAGTTCGAGCTATACCTGTAACCAATGGTGTGTCTGTGAGTGATGCTGTTGATAAGTTCTTC
AAAGAGTACCATTCATCTACCTACTTGTCACACACTGTTGTTCATCAAACTGGCAAACTCCGCCGC
CTTCTTAATGACGCTGAGAATATTTGCACAAAGCTTGCCAACTTGAAGTCTGTACGGCGTACTTCT
GGAGATCCTCCAGGAAAATTTCTTGGAATATTTGGCAGAAATGATCTTGTTGGGAAATATCAGAAA
AGGCTGGAGGACCTAGAAGAAAATGTTAGAATGGAACAATCAGACACTACTAGGAGCAGACAGGAA
GTTCCCGCTGCTTTTGTGTCATTCAGATCTCGATATGGTGCTGCAAATGCTATTTACATAAGACAA
TCAGACAAGCCTACTGAGTGGCAGACTGAGCATGCTCCTGATCCCATGACGTTTATTGGCCTTTC
TTTTCAACATCATTCATGGACAGATGGATATCCAAGTTTGTAGTCTCTGTAGCTTCTATTCTCCTG
ATACTCGTCTTTCTCCTAGTTTCGGCATTTGTTCAAGGACTCACCTATATGGAACAGCTAGAGACA
TGGTTGCCTTTCCTGAGAAATATACTGGAAATAGCTGTTGTCAGTCAGTTGGTTACAGGATATCTT
CCCAGTGTCATTCTTCACTTTCTTTCCTCTTATGTGCCCTCTATAATGAAGCTGTTTTCAACAATG
CAAGGATTCATCTCTGTTAGTGGGATTGAGAGAAGTGCTTGCAACAAAATGCTTCGGTTTACAATA
TGGAGTGTGTTCTTTGCAAATGTTCTTACTGGCTCAGTACTTGGTCAACTCGAGATATTCCTTGAT
CCGAAGGAAATCCCTAAAAGGCTTGCAGTTGTTGTACCAGCACAGGCCTCTTTCTTTATTACATAT
GTTGTGACATCTTGGACAAGTATAGCATCAGAACTTACTCAAACTGCTGCCCTTTTATTCCATTTG
TGGGGTAGCTGTGCAAAATGCTGCAAGAGGGATGAGTCCAAACCTCCATCAATGCATTACCATAGT
GAAATTCCTCGGGTTCTCCTGTTTGGACTTCTTGGGCTCACATACTTCATTGTATCCCCACTTATC
CTCCCATTTGTACTGGTTTACTTCTGCCTTGGCTACTTCATATATCGTAATCAGCTTTTTAATGTA
TATTCACCCAAGTATGACACTGGTGGAAGATTCTGGCCCATTGTGCACGGGGGAACAATATTTTCT
CTGGTGCTGATGCATGTTATTGCAATTGGAGTATTTGGATTGAAGAAACTTCCCCTTGCATCAAGT
TTGCTGGTACCTCTTCCAGTGCTGACCCTTCTGTTCAATGAATACTGCCGGAACAGATTTTTACCG
ATCTTCGAAGCATATTCTACTGAGTCATTGATAAAGAAAGACAGAGAAGAAGAGAGCAAACCAGAA
ATGGCAGAATTCTTCAGCAATCTTGTAAATGCGTACTGTGACCCGGCGATGAAACCTATCCAACAC
TCCTCGAATTCAGATGAACGCACTACACCTCTATTGTCTTAG

SEQ ID NO: 429, protein - Oryza sativa
MILSALATSVGINLGLTVLLAAAYTLLRRRPPYVAVYSPRRPYAPPEPWLPAAWRRTEADVHAAAG
LDGVVFLRIFVFSIRVFAAAAVVGVGVLMPVNFMGDQLRQIDFSDLPNKSVDLFSVSNVQDGSNKL
WLHFSAVYIITGITCYLLYYEYKYISGKRLEYFMTSKPLPQHFTVLVRAIPVTNGVSVSDAVDKFF
KEYHSSTYLSHTVVHQTGKLRRLLNDAENICTKLANLKSVRRTSGDPPGKFLGIFGRNDLVGKYQK
RLEDLEENVRMEQSDTTRSRQEVPAAFVSFRSRYGAANAIYIRQSDKPTEWQTEHAPDPHDVYWPF
FSTSFMDRWISKFVVSVASILLILVFLLVSAFVQGLTYMEQLETWLPFLRNILEIAVVSQLVTGYL
PSVILHFLSSYVPSIMKLFSTMQGFISVSGIERSACNKMLRFTIWSVFFANVLTGSVLGQLEIFLD

FIGURE 24 (continued)

PKEIPKRLAVVVPAQASFFITYVVTSWTSIASELTQTAALLFHLWGSCAKCCKRDESKPPSMHYHS
EIPRVLLFGLLGLTYFIVSPLILPFVLVYFCLGYFIYRNQLFNVYSPKYDTGGRFWPIVHGGTIFS
LVLMHVIAIGVFGLKKLPLASSLLVPLPVLTLLFNEYCRNRFLPIFEAYSTESLIKKDREEESKPE
MAEFFSNLVNAYCDPAMKPIQHSSNSDERTTPLLS

SEQ ID NO: 430, DNA - Oryza sativa
ATGAAAATCAGCGGACTTCTGACCTCTGCTGGCATCAATATCGCTCTTTCTGTGCTGTTTATATCG
CTCTATTCTGTTCTGAGGAAGCAGCCAGCCAATGTCAGGGTCTACTTTGGGAGGAGGATTGCCGAG
GAGCATAATCGGCTCCGAGAAGCTTTTATCTTGGAGAGATTTGTACCATCTACTGGCTGGATAGTA
AAAGCCCTGCAGTGTACCGAGGAAGAGATCTTGGCTGCTGCTGGGCTAGATGCTGTTGTTTTCAAT
AGAATTCTAGTATTCAGCTTACGCATCTTCTCTCTAGCTGCCATTCTGTGTGTGTTTGGAATTCTA
CCCACTGAACTACTTTGGGCAAGATATACATCATGTTCGGATTCCTTCAGAATCATTGGATATCTTT
ACAATTGGGAATGTGAAAGTGAGATCAAGATGGCTTTGGGTCCATTGTGTAGCCTTGTACATAATA
TCAGGAGTAGCTTGCATTCTCCTATATCTTGAGTACAAGCACATTGCTAGGCTGAGGCTCCGTCAT
CTTACTTGTGCAATGCCCAATCCAAGCCATTTACTGTCCTTGTTCGTGGAATACCAAAGGAAACC
AAAGAATCATGCAGTAATGCTATTGATGATTTCTTCACCAAGTACCATGGATCAAGCTACCTGTTC
CATCAAGTTGTTTACAAAGTTGGAAAAGTTCAGAAGATAATGACTGGTGCTAAGAAGGCATACAGG
AAATTCAAACATTTTACAGACAGCACTATTGATCAGAGGTGTCGAGCAATTTCATACCGGTGCTGT
CTGTGCGGAGCCTCATCTAATTCTTTCCAGCTGTTGGCAACTGGGCTTGAGCAGAATCAGGGGAAA
TCTGACCTTCAAGATTCCAGCTTGAAACTAGATGATCAGGAATGTGCAGCTGCTTTTGTATATTTC
AGAACTCGGTATGCTGCTCTTGTTGCCTCAGAAATACTCCAAACATCTAACCCTATGAAATGGGTT
ACTGATCTAGCTCCAGAACCAGATGATGTGTATTGGTCAAATCTTTGGCTACCTTATAAGCAGCTT
TGGATTCGCCGAATAGCTACGCTCCTTGGTTCAATTGTTTTATGTTATTCTTTCTGATACCAGTG
ACATTTATACAAGGACTATCTCAGCTAGAGCAGTTGCAGCAGAGGCTTCCTTTCCTGAAGGGGATA
CTGGAGAAGAAATACATGAGCCAGCTTGTAACTGGGTACCTTCCCAGTGTCATACTGCAAATATTT
TTATATGCCGTTGCACCGATAATGATATTATTTTCTACATTAGAGGGGCCTATATCTCACAGTGAA
AGGAAGAGGAGTGCTTGCTGTAAAGTGCTGTACTTCACTGTTTGGAACATATTCTTTGGAAATGTA
CTATCTGGTACTGTCATAAGCCAATTGAATGTGTTATCAAGCCCAAAGGACATCCCTGTCCAGCTT
GCTAGAGCTATACCTGTCCAGGCTACCTTCTTTATCACCTATGTTCTGACATCAGGATGGGCCAGT
TTATCATCTGAACTTATGCAATTATTTGGTTTAATATGGAACTTTGTGAGGAAATATATTCTACGT
ATGCCAGAAGACACAGAGTTTGTTCCCTCATTCCCATATCACACAGAAGTGCCAAAAGTTTTGCTG
TTCGGACTACTGGGCTTCACATGCTCTGTACTGGCACCTTTGATCTTACCTTTTCTGTTAGTGTAC
TTCTTCCTTGGTTACATCGTGTACCGCAATCAGTTGCTCAATGTTTACCGCACAAGATATGACACA
GGGGGTTTGTACTGGCCAATCGCACACAACGCAGTGATATTCTCTCTCGTGCTCACACAGATTATC
TGCCTTGGTGTATTTGGCCTGAAAGAATCACCAGTAGCTGCAGGCTTCACCATACCTCTTATCATC
CTCACTCTGTTATTCAATCAGTATTGCAGAAATCGACTTCTCCATTATTCAGAACTACCCCAGCA
CAGGATTTAATTGACATGGACAGGGAAGACGAACGGTCAGGAAGAATGGATGAAATTCACCACCGG
CTTCATTCTGCCTATTGTCAGTTCCACGACACTGAAGATATACCCTTGGAGAAAATTCAGACTGTC
GGGAGCGATGAGGAACAAGGGTGTAGCTCTGATAAGTCGAATGGAAAAGAAAGCTTCGAGGAACCC
AGAGCGGAGTTGTCTCACCCAACACTGAATGGACTCCCAGTTAGCCGTCTTCGGCATGCTGTGAAG
TCGATTACTTTCCTTGTCAGATTGCAGAAAGAGGTTTGTCAGAATAG

SEQ ID NO: 431, protein - Oryza sativa
MKISGLLTSAGINIALSVLFISLYSVLRKQPANVRVYFGRRIAEEHNRLREAFILERFVPSTGWIV
KALQCTEEEILAAAGLDAVVFNRILVFSLRIFSLAAILCVFGILPLNYFGQDIHHVRIPSESLDIF
TIGNVKVRSRWLWVHCVALYIISGVACILLYLEYKHIARLRLRHLTCAMPNPSHFTVLVRGIPKET
KESCSNAIDDFFTKYHGSSYLFHQVVYKVGKVQKIMTGAKKAYRKFKHFTDSTIDQRCRAISYRCC
LCGASSNSFQLLATGLEQNQGKSDLQDSSLKLDDQECAAAFVYFRTRYAALVASEILQTSNPMKWV

FIGURE 24 (continued)

TDLAPEPDDVYWSNLWLPYKQLWIRRIATLLGSIVFMLFFLIPVTFIQGLSQLEQLQQRLPFLKGI
LEKKYMSQLVTGYLPSVILQIFLYAVAPIMILFSTLEGPISHSERKRSACCKVLYFTVWNIFFGNV
LSGTVISQLNVLSSPKDIPVQLARAIPVQATFFITYVLTSGWASLSSELMQLFGLIWNFVRKYILR
MPEDTEFVPSFPYHTEVPKVLLFGLLGFTCSVLAPLILPFLLVYFFLGYIVYRNQLLNVYRTRYDT
GGLYWPIAHNAVIFSLVLTQIICLGVFGLKESPVAAGFTIPLIILTLLFNQYCRNRLLPLFRTTPA
QDLIDMDREDERSGRMDEIHHRLHSAYCQFHDTEDIPLEKIQTVGSDEEQGCSSDKSNGKESFEEP
RAELSHPTLNGLPVSRLRHAVKSITFLVRLQKRGLSE

SEQ ID NO: 432, DNA - Arabidopsis thaliana
ATGGATGTCTCAGCACTTTTAACGTCTGCTGGGATTAATATAGCGATATGCGTAGTGCTTGTATCG
CTTTATTCCATTCTACGAAAGCAGCCAGCCAATTATTGTGTTTACTTTGGTCGATTGCTTTCTGAC
GGAAGAGTTAAACGTCATGATCCTCGTTGGTATGAGAGGTTCGCGCCCTCTCCTAGTTGGCTCGTG
AAAGCTTGGGAAACCACTGAGGAAGAGATGTTGGCTGCTGCTGGTCTGGATGCTGTGGTTTTCATC
AGGATGGTCATTTGCAGCATTCGTATTTTCTCAATCGTCGCAGTCGTTTGCCTTGCCTTTGTGTTA
CCTGTTAACTATTATGGACAAAAGATGGAGCACAAGGAAGTCCATTTGGAGTCATTGGGAGTATTC
ACAATTGAGAACCTTAATCCACGCTCACGATGGCTCTGGGTTCATTGTCTCTCATTGTACATCATA
TCCTCTGCAGCATGTGCTCTTCTTTACTTTGAGTATAAGAACATAGCCAAAAGAGGCTTGCCCAT
ATTAGTGGATCTGCCTCAAAGCCAAGTCATTTTACTGTTCTTATTCGTGCTATTCCTCAGTCTCCT
GACCAGTCCTACAGCGAGACAGTGAGCAAATACTTTACAAATTACTATGCACCAAGCTATGTGTCG
CACCTAATGGTCTACCGTGATGGCTTCATTCACAGACTGATGAATGAGACGGAGAGGATGTGTCAG
GCTATAAAACATGTTTCTCCTGATTTAAGTTGTAATCCGAGTTTGAAGTCATGCGTCCTTTGTGGA
CCTGCAGCCACAAATTCTTTTCAAATCATCTCGAACGAGACAGACAGTGTCAAAGGATTGGAGCTT
GGTGAGTTGACTTTGACTACGACAGAGGAAGAACGTCCCGTTGCTTTTGTGTTTTTCAAGAGTCGT
TATGATGCTCTTGTTGTTTCAGAAGTTCTTCAAACACCAAATCCTATGTTATGGGTGGCAGACTTG
GCTCCAGAGCCTCATGATGTTCACTGGAGAAATCTCAGAATACCTTATCGGCAGCTTTGGATGCGA
AGAATAGCAACCCTTGTTGGTGCAATTGCCTTCATGTTTGTGTTTCTTTTTCCTGTTACCTTTGTT
CAAGGGCTGACTCAACTACCAACGTTATCCAAGAATTTTCCTTTTCTAAAAGACCTCTTGAACAGG
AGGTTTATGGAGCAGGTCATCACAGGGTATTTACCAAGTGTGATTTTGGTTCTATTCTTTTATACC
GTTCCGCCATTGATGATGTACTTTTCAACCTTGGAGGGATGTGTTTCTCGGAGTCAAAGAAAAAAA
AGTGCATGTCTCAAAATTTTATACTTCACCATCTGGAATGTGTTCTTCGTCAATATTCTATCAGGC
TCTGTTATCAGGCAGTTTACCGTCTTGAATAGTGTGAGGGACGTACCTGCACAACTTGCGAAACTT
GTTCCAGCACAGGCTGGCTTCTTCATGACCTATTGTTTCACGTCTGGTTGGGCCGGTTTGGCATGT
GAAATCATGCAACCTGTAGGTCTTATTTGGAATCTGATTGCAAAAGTTATTGTTAAGAACAAGGAG
GAGTCATATGAAACACTTAGGTTTCCCTACCATACAGAAATTCCAAGACTACTTTTGTTCGGGCTC
CTGGGTTTCACCAATTCAGTCATAGCGCCTCTGATACTGCCGTTCTGCTGATCTACTTTTTCTTC
GCATATCTTATATACAAAAATCAGATAATCAACGTCTATATTACAAAGTATGAAAGCGGTGGACAA
TATTGGCCTGTTTTTCACAACACTACAATCTTTTCACTGATCTTGTCGCAAGTTATAGCTCTAGGC
TTTTTCGGGTTAAAGCTATCAACGGTTGCTTCAGGTTTCACCATCCCGTTAATCCTTCTCACTCTT
CTATTTAGTGAGTATTGCCGGCAAAGGTTTGCGCCCATATTCCAGAAATATCCAGCCGAGATTCTT
ATCGCTATGGACAGAGCAGATGAGATGACAGGAAAGATGGAAGAGATACATAACAACTTGAAAGTT
GCATACTCTCAGATACCAACGTGTTCTGAAGAATCCAGCAAAGCTGGTTGCACTTCTCCTTGCTCA
GATCAGGAGTTACCAGATTCTGAAGAGTTGAAGCCTGAGAAAGAGAATCTTAAAGCTGATTACATA
TGGGAGTTCCAGAGAAGTAAATCTGGTCTTGATCTTGAGGTGAAATCCTGTCCCAGTGCTTCCCCA
ATTCGTAATTCCCCAGGGTTTGCCGAGATCTACAAACGAACATAG

SEQ ID NO: 433, protein - Arabidopsis thaliana
MDVSALLTSAGINIAICVVLVSLYSILRKQPANYCVYFGRLLSDGRVKRHDPRWYERFAPSPSWLV
KAWETTEEEMLAAAGLDAVVFIRMVICSIRIFSIVAVVCLAFVLPVNYYGQKMEHKEVHLESLGVF FIGURE 24 (continued)

TIENLNPRSRWLWVHCLSLYIISSAACALLYFEYKNIAKKRLAHISGSASKPSHFTVLIRAIPQSP
DQSYSETVSKYFTNYYAPSYVSHLMVYRDGFIHRLMNETERMCQAIKHVSPDLSCNPSLKSCVLCG
PAATNSFQIISNETDSVKGLELGELTLTTTEEERPVAFVFFKSRYDALVVSEVLQTPNPMLWVADL
APEPHDVHWRNLRIPYRQLWMRRIATLVGAIAFMFVFLFPVTFVQGLTQLPTLSKNFPFLKDLLNR
RFMEQVITGYLPSVILVLFFYTVPPLMMYFSTLEGCVSRSQRKKSACLKILYFTIWNVFFVNILSG
SVIRQFTVLNSVRDVPAQLAKLVPAQAGFFMTYCFTSGWAGLACEIMQPVGLIWNLIAKVIVKNKE
ESYETLRFPYHTEIPRLLLFGLLGFTNSVIAPLILPFLLIYFFFAYLIYKNQIINVYITKYESGGQ
YWPVFHNTTIFSLILSQVIALGFFGLKLSTVASGFTIPLILLTLLFSEYCRQRFAPIFQKYPAEIL
IAMDRADEMTGKMEEIHNNLKVAYSQIPTCSEESSKAGCTSPCSDQELPDSEELKPEKENLKADYI
WEFQRSKSGLDLEVKSCPSASPIRNSPGFAEIYKRT

SEQ ID NO: 434, DNA - Arabidopsis thaliana
ATGGCAACACTAGGAGATATTGGAGTAGCAGCAGCAATCAACATACTCACTGCAATCATCTTCCTT
TTGGCATTTGCAATCTTGAGGATTCAACCATTCAACGATAGGGTTTATTTCCCTAAATGGTATCTC
AAAGGTATAAGAAGCAGCCCTTTGCATTCAGGTGCTCTTGTCAGCAAGTTTGTCAATGTTAACTTA
GGCTCATACCTCCGGTTCTTGAACTGGATGCCCGCGGCTCTAAAGATGCCTGAGCCTGAGCTTATT
GATCATGCTGGATTGGATTCTGCTGTCTACTTGAGGATTTACTTGATAGGGCTTAAGATCTTTGTA
CCGATAGCGTTACTTGCTTGGTCGATTCTTGTACCTGTCAATTGGACTAGTCATGGTCTGCAACTA
GCTAAGCTTCGTAATGTGACATCAGTGATATTGATAAGTTATCCATCTCGAATATCGAAAATGGA
TCAGACAGGTTTTGGACTCACCTTGTGATGGCTTACGCATTCACATTCTGGACTTGCTATGTTCTT
ATGAAAGAGTATGAGAAAGTAGCTGCTATGCGTTTGGCATTTCTCCAGAACGAGCAACGGCGCCCT
GATCAGTTCACGGTTTTGGTTAGGAACGTACCAGCGGACCCAGATGAGTCCATTAGTGACAGTGTG
GAACATTTCTTTCTAGTTAACCATCCGGACCATTATCTTACGCATCAGGTTGTGTACAATGCAAAC
GATTTGGCAGCATTAGTAGAGCAGAAGAAGAGCACACAGAACTGGCTTGACTATTACCAATTGAAG
TATACAAGGAACCAGGAACATAAGCCGAGGATAAAGACGGGTTTTCTCGGCTATGGGGAAAGAAAAA
GTTGACGCAATCGATCATTATATAGCTGAAATCGAGAAATTAAACGAGCAAATAATGGAGGAGAGG
AAAAAAGTGAAGAAAGATGATACAAGTGTAATGCCAGCCGCTTTTGTCTCGTTTAAAACACGGTGG
GGTGCTGCGGTTAGTGCACAGACTCAACAGTCGAGTGATCCGACTGAATGGTTAACTGAATGGGCT
CCCGAGGCACGAGAAGTGTTTTGGTCGAACCTTGCAATACCTTATGTCTCTTTAACACATCGAAGG
CATTGA

SEQ ID NO: 435, protein - Arabidopsis thaliana
MATLGDIGVAAAINILTAIIFLLAFAILRIQPFNDRVYFPKWYLKGIRSSPLHSGALVSKFVNVNL
GSYLRFLNWMPAALKMPEPELIDHAGLDSAVYLRIYLIGLKIFVPIALLAWSILVPVNWTSHGLQL
AKLRNVTSSDIDKLSISNIENGSDRFWTHLVMAYAFTFWTCYVLMKEYEKVAAMRLAFLQNEQRRP
DQFTVLVRNVPADPDESISDSVEHFFLVNHPDHYLTHQVVYNANDLAALVEQKKSTQNWLDYYQLK
YTRNQEHKPRIKTGFLGLWGKKVDAIDHYIAEIEKLNEQIMEERKKVKKDDTSVMPAAFVSFKTRW
GAAVSAQTQQSSDPTEWLTEWAPEAREVFWSNLAIPYVSLTHRRH

SEQ ID NO: 436, DNA - Arabidopsis thaliana
ATGGAGTTTGGATCTTTTCTTGTGTCCTTAGGGACATCTTTTGTTATCTTCGTCATTCTCATGCTT
CTCTTCACCTGGCTTTCTCGCAAATCTGGAAATGCTCCCATTTATTACCCGAATCGGATCCTTAAA
GGGCTGGAGCCATGGGAAGGCACCTCCTTGACTCGAAACCCTTTTGCTTGGATGCGTGAAGCTTTG
ACTTCCTCTGAACAAGATGTCGTTAACTTATCCGGCGTCGATACTGCTGTCCACTTTGTCTTCTTG
AGCACTGTTCTGGGGATATTTGCTTGTTCCAGTCTTCTTCTCCTACCAACTCTACTGCCTCTAGCC
GCTACAGACAACAACATAAAGAACACAAAGAATGCGACAGATACCACAAGCAAAGGAACTTTTAGC
CAACTTGATAATCTATCAATGGCTAACATCACAAAAAAAGTTCGAGGCTGTGGGCGTTCCTAGGA
GCTGTTTACTGGATATCTTTGGTCACATATTTCTTCTTGTGGAAAGCTTATAAGCATGTCTCTTCA FIGURE 24 (continued)

TTGAGAGCTCAAGCTCTGATGTCTGCTGATGTAAAACCCGAGCAATTCGCTATTCTTGTTAGGGAT
ATGCCTGCACCACCTGACGGGCAGACACAGAAAGAGTTTATTGATTCTTATTTCAGAGAAATATAC
CCTGAGACATTCTACAGATCGCTTGTCGCAACAGAAAACAGCAAGGTTAATAAAATATGGGAAAAA
TTGGAAGGTTACAAGAAGAAGCTTGCGCGAGCAGAAGCAATATTAGCAGCAACTAATAACCGTCCC
ACGAACAAAACCGGCTTCTGTGGGCTAGTCGGTAAACAAGTAGACAGCATTGAGTATTACACTGAG
CTAATCAACGAGTCTGTAGCCAAACTGGAAACAGAGCAGAAAGCGGTTCTTGCTGAGAAGCAGCAA
ACCGCAGCAGTGGTTTTCTTCACAACCAGGGTTGCTGCTGCATCAGCAGCTCAGTCTCTGCACTGC
CAGATGGTTGATAAATGGACTGTGACCGAAGCTCCTGAGCCACGGCAGCTCCTATGGCAGAATCTC
AACATCAAGCTCTTCAGCAGAATAATCCGGCAATACTTCATCTACTTCTTTGTTGCAGTGACCATT
CTGTTTTACATGATACCAATCGCGTTCGTCTCTGCCATCACCACTCTTAAGAATCTTCAGAGGATT
ATTCCGTTCATAAAGCCGGTTGTGGAGATAACCGCCATAAGAACCGTTTTGGAGTCTTTCCTTCCT
CAGATTGCGCTCATTGTTTTCTTGGCCATGTTGCCGAAGCTTCTCTTGTTTCTCTCCAAAGCCGAG
GGGATTCCTTCACAGAGCCATGCCATTAGGGCTGCTTCAGGGAAGTACTTTTACTTCTCGGTCTTT
AATGTCTTCATTGGTGTTACCCTTGCTGGGACTTTGTTCAACACAGTGAAGGATATCGCGAAAAAT
CCCAAACTCGACATGATTATTAACCTTTTGGCTACTAGCCTCCCTAAGAGCGCAACTTTCTTCCTG
ACCTACGTTGCTCTCAAGTTCTTTATCGGTTATGGCCTTGAGCTGTCTCGGATCATACCTTTGATA
ATCTTCCACCTGAAAAAGAAGTATCTCTGCAAAACCGAAGCGGAGGTCAAAGAAGCTTGGTACCCG
GGAGACTTAAGCTATGCGACTAGGGTTCCCGGAGACATGCTCATCCTCACAATCACGTTCTGCTAT
TCAGTCATTGCTCCTCTTATCCTCATATTCGGCATCACCTACTTTGGTTTAGGCTGGCTAGTCCTC
AGGAATCAGGCGTTGAAAGTGTACGTTCCATCATACGAGAGCTATGGAAGAATGTGGCCGCATATT
CACCAGCGCATACTAGCAGCGTTGTTTCTATTCCAAGTGGTAATGTTTGGCTACTTAGGAGCCAAG
ACATTCTTCTACACGGCCCTTGTGATCCCTCTCATTATCACCTCTCTCATCTTCGGATATGTGTGC
CGCCAGAAATTCTACGGAGGGTTCGAACACACAGCTCTCGAGGTAGCTTGCCGTGAGCTGAAGCAG
AGTCCAGACCTAGAGGAGATTTTCAGAGCATACATTCCGCATAGCTTGAGCTCTCACAAACCAGAA
GAACACGAGTTCAAAGGCGCAATGTCTCGTTATCAAGATTTCAACGCAATAGCAGGCGTTTAA

SEQ ID NO: 437, protein - Arabidopsis thaliana
MEFGSFLVSLGTSFVIFVILMLLFTWLSRKSGNAPIYYPNRILKGLEPWEGTSLTRNPFAWMREAL
TSSEQDVVNLSGVDTAVHFVFLSTVLGIFACSSLLLLPTLLPLAATDNNIKNTKNATDTTSKGTFS
QLDNLSMANITKKSSRLWAFLGAVYWISLVTYFFLWKAYKHVSSLRAQALMSADVKPEQFAILVRD
MPAPPDGQTQKEFIDSYFREIYPETFYRSLVATENSKVNKIWEKLEGYKKKLARAEAILAATNNRP
TNKTGFCGLVGKQVDSIEYYTELINESVAKLETEQKAVLAEKQQTAAVVFFTTRVAAASAAQSLHC
QMVDKWTVTEAPEPRQLLWQNLNIKLFSRIIRQYFIYFFVAVTILFYMIPIAFVSAITTLKNLQRI
IPFIKPVVEITAIRTVLESFLPQIALIVFLAMLPKLLLFLSKAEGIPSQSHAIRAASGKYFYFSVF
NVFIGVTLAGTLFNTVKDIAKNPKLDMIINLLATSLPKSATFFLTYVALKFFIGYGLELSRIIPLI
IFHLKKKYLCKTEAEVKEAWYPGDLSYATRVPGDMLILTITFCYSVIAPLILIFGITYFGLGWLVL
RNQALKVYVPSYESYGRMWPHIHQRILAALFLFQVVMFGYLGAKTFFYTALVIPLIITSLIFGYVC
RQKFYGGFEHTALEVACRELKQSPDLEEIFRAYIPHSLSSHKPEEHEFKGAMSRYQDFNAIAGV

SEQ ID NO: 438, DNA - Arabidopsis thaliana
ATGGTCATTTTCAGCATTCGTATTTCTTTATAGTTGCTGTTATTTGCATTGCCTTTGTGCTGCCT
GTTAATTATTATGGGCAACCGATGGTGCATAAGGAAATCCATTTGGAGTCATCCGAAGTGTTTACA
ATTGAAAATCTTAAAGAAGGCTCAAAATGGCTGTGGGTTCATTGTCTTGCACTGTACATTATAACC
TCAGCGGCATGTCTTCTGCTCTACTTTGAGTATAGCACCATAGCTAAAATGAGGCTTGGGCATATT
ACTGGATGTGCCTCAAAGCCAAGTCAATTTACCGTTCTTATCCGTGCTATTCCATGGTCTCCTGAG
CAATCTTACAGCGACACGCTGAGCAAATTCTTCACAAACTACTACTCGTCCAGCTACGTGTCCCAC
CAAATGGTCTACCATAATGGCATCATTCAGAGACTGCTGCGTGATGCGGAGAGGATGTGCCAGACT
CTAAAACACGTTTCTCCTGAAATCAATTGTAAACCGAGTTTAAGGCCATGCACCTTTTGTGGAGGA FIGURE 24 (continued)

CCTACAGCCACAAGTTCTTTTCATATCCTATCGAATGAGGCAGACAGTGTGAAAGGAATGGAGCTT
GGTGAGTTGACTATGACTACGACTACGACAGAGCAAGAACGTTCAGCTGCTTTTGTGTTTTTTAAG
ACTCGCTATGATGCTCTTGTTGTTTCGGAGGTTCTACAATCATCAAATCCTATGTTATGGGTGACA
GACTTAGCCCCAGAACCTCATGATGTGTACTGGAAGAATCTCAACATTCCTTATCGACAACTTTGG
ATACGGAAAATAGCAACCCTTGTTGGTGCAGTTGCTTTCATGTTTGTGTTTCTTATTCCCGTTACC
TTCATTCAAGGGCTGACTCAACTAGTGCAGCTGTCTCACGCATTTCCTTTTCTAAGAGGCATCTTG
AGCAAGAACTTTATAAACCAGGTCATCACAGGGTACTTACCCAGTGTGATCTTGATTCTATTTTTC
TATGCCGTTCCACCATTGATGATGTATTTTCGGCCTTGGAGGGATGTATTTCACGGAGTATAAGG
AAGAAGAGTGCTTGCATCAAAGTCTTATATTTTACCATTTGGAATGTGTTCTTCGTGAATATATTA
TCAGGGTCTGTTATCAGGCAACTGAATGTCTTTTCTAGTGTCAGAGACATACCTGCACAACTTGCT
AGAGCAGTGCCAACACAGGCTGGCTTCTTCATGACCTATTGTTTCACATCTGGTTGGGCCAGTTTG
GCTTGTGAAATAATGCAGCCTATGGCTCTTATCTGGAATCTGGTAGCAAAAGTTGTTACCAAGAAC
GAGGATGAGTCATATGAAACACTTAGGTTCCCATACCACACCGAAATTCCTCGGCTGCTTTTGTTT
GGGCTCCTGGGTTTCACCAATTCAGTCATAGCACCACTGATACTGCCGTTTTGCTGATATACTTT
TTCCTTGCATATCTCATATACAAAAATCAAATACTCAACGTGTATATTACGAAGTACGAAAGCGGT
GGACAATACTGGCCTATTTTCCACAACACAACAATCTTTTCACTGATCTTGACACAGATTATAGCT
TTGGGGTTTTTCGGATTAAAGCTATCAACAGTTGCTTCGGGTTTCACCATACCGTTAATTCTTCTC
ACGTTACTTTTTAGTGAGTATTGTCGGCAGAGGTTTGCGCCCATTTTCAACAAAAATCCTGCCCAG
GTTCTCATAGATATGGACAGAGCTGATGAAATATCAGGAAAGATGGAAGAGTTACATAAAAAATTG
CATAATGTATACTCGCAGATACCATTACACTCTCAGAAATCATCGAGTAAAGCTGAATGTAGTAAT
CCTTTCAAAAAGCAGGAGTTACCAGATCCTGAAAAATTGAAGCCAGAGGAGGGGGATGCGATAGCT
AAAGAGTTATGGGGATTCCAAGGCAATGAATCTGGTCAAGAACATGACACTAAGTCCTGA

SEQ ID NO: 439, protein - Arabidopsis thaliana
MVIFSIRIFFIVAVICIAFVLPVNYYGQPMVHKEIHLESSEVFTIENLKEGSKWLWVHCLALYIIT
SAACLLLYFEYSTIAKMRLGHITGCASKPSQFTVLIRAIPWSPEQSYSDTLSKFFTNYYSSSYVSH
QMVYHNGIIQRLLRDAERMCQTLKHVSPEINCKPSLRPCTFCGGPTATSSFHILSNEADSVKGMEL
GELTMTTTTTEQERSAAFVFFKTRYDALVVSEVLQSSNPMLWVTDLAPEPHDVYWKNLNIPYRQLW
IRKIATLVGAVAFMFVFLIPVTFIQGLTQLVQLSHAFPFLRGILSKNFINQVITGYLPSVILILFF
YAVPPLMMYFSALEGCISRSIRKKSACIKVLYFTIWNVFFVNILSGSVIRQLNVFSSVRDIPAQLA
RAVPTQAGFFMTYCFTSGWASLACEIMQPMALIWNLVAKVVTKNEDESYETLRFPYHTEIPRLLLF
GLLGFTNSVIAPLILPFLLIYFFLAYLIYKNQILNVYITKYESGGQYWPIFHNTTIFSLILTQIIA
LGFFGLKLSTVASGFTIPLILLTLLFSEYCRQRFAPIFNKNPAQVLIDMDRADEISGKMEELHKKL
HNVYSQIPLHSQKSSSKAECSNPFKKQELPDPEKLKPEEGDAIAKELWGFQGNESGQEHDTKS

SEQ ID NO: 440, DNA - Arabidopsis thaliana
ATGGCGACATTAGCAGATATTGGACTAGCAGCAGCGATTAATATTCTAAGTGCATTGATATTCTA
TTGCTATTTGCAATCTTGAGGATTCAACCATTCAATGATAGGGTTTATTTCCCTAAATGGTACTTA
AAAGGTGTTAGAAGCAGCCCTGTGAATTCGGGTGCTTTCGTTAGCAAGATTATGAATTTGGACTTT
CGATCATACGTTCGGTTTTTAAACTGGATGCCTGATGCTCTTAAGATGCCAGAGCCTGAACTTATT
GATCATGCTGGTTTGGATTCTGCTGTTTACTTGAGGATTTACTTGATTGGCTTAAGATCTTTGGT
CCGATTGCATTACTTTCATGGTCAATTTTAGTACCTGTAAATTGGACAAGTGATGGATTGCAGCTA
GCAAAACTTCGTAATGTAACATCGAGTAATATCGATAAGCTTTCGATTTCGAATGTCGAACGTGGA
TCAGACAGGTTTTGGGCACATCTTGTGATGGCTTATGCATTCACATTTGGACTTGCTATGTACTA
ATGAAGGAATATGAGAAATTGCTGCAATGCGGTTATCTTTCTCCAATCAGAGAAGCGACGTGCT
GATCAATTCACTGTTCTGGTTAGGAACGTACCACCGGACTCAGACGAGTCGATTAGCGAAACGTG
CAGCATTTCTTTCTTGTTAACCACCCAGACCATTATCTTACACATCAGGTGGTGTACAATGCAAAT
GAATTGGCTAAATTGGTAGAAGACAAGAAGAAAATGCAGAATTGGTTAGATTACTACCAGTTGAAG

```
TATACAAGAAACAAGGAACAACGGCCACGGATGGGATTTCTCGGGCTATGGGGCAAAAAAGTAGAT
GCAATGGATCATTATACAGCAGAGATCGAGAAACTTAGCGAGCAAATAATGGAAGAAAGGAAGAGG
ATAAAGAAAGATGACAAAAGTGTAATGCAAGCAGCTTTTGTGTCTTTTAAAACGCGTTGGGGCGCT
GCGGTCTGCGCGCAGACACAACAGACGAAGAATCCAACTGAATGGTTAACCGAATGGGCTCCTGAG
GCAAGAGAAATGTACTGGCCAAATCTCGCAATGCCTTACGTATCTCTCACTGTAAGGAGATTTGTA
ATGCACATCGCCTTCTTCTTCCTCACGTTCTTTTTCATCATCCCAATCGCATTTGTGCAATCCTTA
GCGAGTATTGAAGGTATCGAGAAATCCGCTCCGTTCCTCAGTCCCATTGTCAAAAACAAGTTAATG
AAATCATTGATCCAAGGTTTTCTTCCCGGTATTGTCTTGAAGCTCTTTTTGATATTCCTGCCAACA
ATATTGATGATCATGTCGAAATTCGAAGGGTTTATTTCAATATCATCGTTAGAGAGAAGAGCGGCT
TTTCGATACTATATTTTCAACCTTGTGAATGTTTTCCTCGGTAGCGTAATCACTGGATCTGCTTTT
GAACAGCTCGATTCTTTTCTTAAACAATCCGCAAACGACATTCCGCGGACAGTTGGAGTCGCGATA
CCGATAAAAGCAACGTTCTTTATAACGTATATAATGGTAGACGGTTGGGCGGGTGTGGCGGGAGAA
ATCTTTAGGCTGAAACCATTAGTCATTTTCCATTTAAAGAACTTCTTCTTTGTGAAAACTGAAAAG
GATAGAGAAGAAGCTATGGATCCGGGACAGATTGATTTCTACGCTACCGAGCCTCGGATTCAACTA
TACTTCCTCCTTGGCCTTGTCTACGCTCCTGTCACTCCTGTTCTTCTTCCTTTCATCATCTTCTTC
TTTGGTTTCGCCTACCTCGTCTTCCGTCATCAGAAGTATGAGAGTGCGGGTGCATTCTGGCCAGAC
GTTCATGGACGTATAATATCGGCATTGATCATCTCACAAATCCTTTTGTTGGGATTAATGAGCACG
AAAGGAAAAGTTCAGTCCACACCTTTCCTCCTCGTTCTAGCGATTCTCACCTTCGGTTTTCATCGG
TTTTGCAAAGGCCGGTACGAATCGGCATTCGTCATTAACCCGTTGCAGGAAGCTATGATTAAGGAT
ACATTGGAACGAGCAAGAGAACCAAACTTGAATCTTAAAGGGTTTCTTCAGAATGCATATGTTCAT
CCTGTTTTTAAAGACGAAGAAGATTCAGATGAAGAGGGACTAATCGAGGATTCAGATGACGAAGAT
TGTGTAGTTGTACAAACCAAACGTCAAAGATCACGGAGAACCACCGTTGCGAGCAGCAATGCGAGC
CGTGGCTCGTCACAATCAACGCCTTTTAATCAACTTGATTTGGGTAAGGGGAAACCGGAGACTTGA
```

SEQ ID NO: 441, protein - Arabidopsis thaliana
MATLADIGLAAAINILSALIFLLLFAILRIQPFNDRVYFPKWYLKGVRSSPVNSGAFVSKIMNLDF
RSYVRFLNWMPDALKMPEPELIDHAGLDSAVYLRIYLIGLKIFGPIALLSWSILVPVNWTSDGLQL
AKLRNVTSSNIDKLSISNVERGSDRFWAHLVMAYAFTFWTCYVLMKEYEKIAAMRLSFLQSEKRRA
DQFTVLVRNVPPDSDESISENVQHFFLVNHPDHYLTHQVVYNANELAKLVEDKKKMQNWLDYYQLK
YTRNKEQRPRMGFLGLWGKKVDAMDHYTAEIEKLSEQIMEERKRIKKDDKSVMQAAFVSFKTRWGA
AVCAQTQQTKNPTEWLTEWAPEAREMYWPNLAMPYVSLTVRRFVMHIAFFFLTFFFIIPIAFVQSL
ASIEGIEKSAPFLSPIVKNKLMKSLIQGFLPGIVLKLFLIFLPTILMIMSKFEGFISISSLERRAA
FRYYIFNLVNVFLGSVITGSAFEQLDSFLKQSANDIPRTVGVAIPIKATFFITYIMVDGWAGVAGE
IFRLKPLVIFHLKNFFFVKTEKDREEAMDPGQIDFYATEPRIQLYFLLGLVYAPVTPVLLPFIIFF
FGFAYLVFRHQKYESAGAFWPDVHGRIISALIISQILLLGLMSTKGKVQSTPFLLVLAILTFGFHR
FCKGRYESAFVINPLQEAMIKDTLERAREPNLNLKGFLQNAYVHPVFKDEEDSDEEGLIEDSDDED
CVVVQTKRQRSRRTTVASSNASRGSSQSTPFNQLDLGKGKPET

SEQ ID NO: 442, DNA - Arabidopsis thaliana
```
ATGCTTTTGTCTGCACTTCTTATGTCTGTTGGGATAAACTCTTGCCTATGTGTATTACTCTTCATT
CTTTACTCTGTACTGAGGAAGCAGCCACGAAACTACGAGGTTTTTTTACCTCGCAGACTCGCGAAT
GGGACGTATAAACGTAGACGCAACAAAGTAGCAAGGTATATACCTTCTCTTAAATGGATTTGGAAA
TCATGGAGACCAACAGAAAAGGAACTTATGGAATCATCTGGCTTGGATGGTGTTGTGTTTATGAGA
ATGATCACTTTTAGTTTGAAAGTGTTCTTGTTTGCTGGTATCATTGGTGTTTTGTTCTCTTGCCT
GTGAACTGCTTTGGAGATCAACTTACAGTGATTGATTACGCTGACTGGTCAGCCAATTCTTTGGAT
CTGTTTTCTGTTGCAAACCTCAAAGTCCGCTCACAATGGCTATGGGTTCACTTTGGAGCTATATAT
CTTGTGACTGTATTTGTTTGCTGTCTTCTTTACTTTGAATTCAGATATATTGCGTTGAAAAGGATT
GAGCATTTCTATTCATCTAAACCTAAGCCAGAACAGTTTACAATATTGGTTCGAAATATCCCCTCT
```

FIGURE 24 (continued)

```
TCAGATGGAAGCAGTGTGAGCGACACTGTTGATAGGTTCTTTGGTGAAAATCATTCCTCTACCTAT
TTTTCTCATGTGGTTATCCATCGAACAAGTAAACTCCGAAGTGTCGTTGATAAGGCTAAAAAGTTA
TATAAAGAAGTGAAACATAAGAAGCCAGTTAAAAAGACGCCAATGAGATTCTTCAGTCGTAAAGAC
AATACTGAGGGTCACTATGAGAGTGTGTTACAGGAAATGGAACAGAACATACGATTGGGGCAAGCT
GAAGTTTCAGCACCTGGAAAGGAAGTTCGAGCTGCTTTTGTATCATTCAAGTCTCGATATGGTGCT
GCAACAGCACTCCACATGCCACAATCAATCAACCCTACTTACTGGCTCACAGAACCAGCACCAGAA
CCTCATGACGTACACTGGCCTTTCTTCTCTGCATCATTTATGCAGAAATGGCTTGCTAAAATTCTG
GTTGTGTTCGCTTGTCTCCTCCTTACTATCTTATTTCTTGTTCCAGTAGTACTTGTCCAAGGTCTC
ACCAACCTTCCTGCACTAGAATTTATGTTCCCGTTCTTGTCATTGATCCTATCAATGAAAGTTGTA
AGTCAAATAATAACTGGATACCTTCCAAGTCTTATACTTCAGACATCTCTCAAAGTCGTACCTCCA
ACCATGGAGTTTCTCTCTTCTATCCAAGGGCACATTTGCCACAGCGATATACAAAAGAGTGCTTGT
AACAAGGTGATCTGGTTCACTATATGGAATGTGTTTTCGCAACTGTTTTCTCTGGATCAGCCTTC
TACAAGCTTTCTGTAATTCTCGATCCAAAGCAAATCCCGCTCAAGTTGGCTGTGGCTGTTCCAGCT
CAGGCTTCGTTTTTCATCGCTTATGTTGTGACAACAGGATGGACAGATACTCTGACTGAACTCTTC
CGTGTAGTTCCCTTCATGGTCAGTTACATAAAAAGATCTTTTGAACCGTCAGATGAAATGAATTT
GTTGTACCGCCAATGCGGTACCACAGAGACACTCCTAGAGTTCTCTTCTTTGGGCTTCTTGGGATT
ACATACTTCTTCTTAGCTCCATTGATTCTTCCTTTCATCCTTTTATACTTTATCCTTGCATACATC
ATCTACCGAAACCAGTTTATGAATGTGTATGCTCCAAAGTTTGATACGGGTGGAATGTTTTGGCCA
ATGATACACTATACGATGATATTCTCTCTTGTACTTATGCAAGCAATTGCAATCGGTCTATTTGCG
CTAAAGAAGATGGAACTAGCTACATACTTGCTTGTCCCTCTTCCCGTTTTTACTCTTCTCTTTAAC
GAGTTCTGTCGTAAACGCTTCATGCCTATATTCACTGATTATCCTGCTGAGGTGTTGACAAAGAGA
GATAAGGAAGATAGAAACGATCCAACAATGCCCGAGTTTTACAATAACTTGGTCAGTGCGTACAAA
GATCCTGCTCTGCTCCCACTTAGATTCTCAGGATCAGGAAGCAGAAACGATAGCCTCACTAGTCCT
CTTCTCTCTTTTAGTGAGGTTTGA
```

SEQ ID NO: 443, protein - Arabidopsis thaliana
MLLSALLMSVGINSCLCVLLFILYSVLRKQPRNYEVFLPRRLANGTYKRRRNKVARYIPSLKWIWK
SWRPTEKELMESSGLDGVVFMRMITFSLKVFLFAGIIGVFVLLPVNCFGDQLTVIDYADWSANSLD
LFSVANLKVRSQWLWVHFGAIYLVTVFVCCLLYFEFRYIALKRIEHFYSSKPKPEQFTILVRNIPS
SDGSSVSDTVDRFFGENHSSTYFSHVVIHRTSKLRSVVDKAKKLYKEVKHKKPVKKTPMRFFSRKD
NTEGHYESVLQEMEQNIRLGQAEVSAPGKEVRAAFVSFKSRYGAATALHMPQSINPTYWLTEPAPE
PHDVHWPFFSASFMQKWLAKILVVFACLLLTILFLVPVVLVQGLTNLPALEFMFPFLSLILSMKVV
SQIITGYLPSLILQTSLKVVPPTMEFLSSIQGHICHSDIQKSACNKVIWFTIWNVFFATVFSGSAF
YKLSVILDPKQIPLKLAVAVPAQASFFIAYVVTTGWTDTLTELFRVVPFMVSYIKRSFEPSDENEF
VVPPMRYHRDTPRVLFFGLLGITYFFLAPLILPFILLYFILAYIIYRNQFMNVYAPKFDTGGMFWP
MIHYTMIFSLVLMQAIAIGLFALKKMELATYLLVPLPVFTLLFNEFCRKRFMPIFTDYPAEVLTKR
DKEDRNDPTMPEFYNNLVSAYKDPALLPLRFSGSGSRNDSLTSPLLSFSEV

SEQ ID NO: 444, DNA - Arabidopsis thaliana
```
ATGCTTCTGTCAGCACTTTTAACTTCAGTGGGAATCAATCTTGGCCTCTGTTTTCTCTTCTTCACT
TTGTATTCAATATTGAGAAAGCAGCCTAGTAATGTCACTGTATACGGTCCACGTCTTGTTAAAAAA
GATGGCAAGTCTCAGCAGTCAAATGAGTTCAACCTCGAGAGGCTTTTGCCTACTGCTGGTTGGGTC
AAAAGAGCATTGGAACCTACCAATGATGAAATCCTCTCCAATCTTGGCTTAGATGCTTTGGTCTTC
ATTCGTGTCTTTGTCTTCAGCATAAGAGTGTTTAGCTTTGCATCTGTGGTTGGGATCTTCATACTT
CTTCCAGTGAATTATATGGGAACAGAGTTTGAAGAGTTTTCGACCTCCCAAAGAAGTCTATGGAT
AACTTCAGTATCTCTAATGTTAACGATGGATCAAATAAGCTGTGGATCCACTTTTGCGCAATATAC
ATCTTCACGGCGGTTGTTTGTTCTCTACTTTACTATGAGCACAAGTACATTTAACAAAGCGGATT
GCTCATCTTTATTCATCCAAGCCTCAGCCACAAGAATTTACAGTTCTGGTCAGTGGCGTCCCTCTT
```

FIGURE 24 (continued)

```
GTATCCGGGAACAGTATTAGTGAGACAGTAGAAAACTTTTTCAGGGAATATCATTCTTCCTCGTAT
CTTTCTCATATAGTTGTTCATCGGACAGACAAGTTGAAAGTTCTCATGAATGATGCTGAGAAGCTG
TACAAGAAGCTTACACGAGTAAAATCCGGAAGCATATCTCGCCAAAAGTCTAGGTGGGGTGGGTTT
CTAGGGATGTTTGGGAATAATGTTGATGTGGTTGACCATTACCAAAAGAAGCTTGATAAGTTAGAA
GATGACATGAGATTGAAACAGTCTTTATTAGCAGGAGAGGAAGTTCCAGCTGCTTTTGTTTCCTTT
AGGACAAGACATGGTGCTGCAATAGCAACAAACATTCAGCAAGGAATAGATCCAACACAATGGCTA
ACTGAGGCAGCCCCGGAGCCCGAAGATGTTCATTGGCCATTTTCACTGCATCGTTTGTGAGAAGA
TGGATCTCCAATGTAGTGGTGCTTGTGGCTTTCGTAGCTCTTTTGATCCTATACATTGTCCCCGTT
GTATTGGTTCAAGGTCTTGCTAATCTTCACCAGTTGGAGACTTGGTTCCCTTTTCTAAAAGGAATA
TTAAATATGAAAATCGTGAGTCAAGTGATTACGGGATATCTTCCGAGTCTCATTTTCCAGCTTTTC
CTTCTTATAGTACCACCCATTATGCTTCTACTTTCCTCAATGCAAGGATTCATTTCTCATAGCCAG
ATTGAGAAATCTGCATGTATCAAGCTTCTAATCTTTACTGTATGGAACAGTTTCTTTGCAAATGTA
CTGTCCGGATCTGCCCTTTATCGTGTTAATGTGTTCCTTGAACCTAAGACTATTCCTCGTGTGCTT
GCTGCAGCTGTGCCAGCACAGGCATCGTTCTTTGTATCTTATGTTGTGACCTCTGGATGGACTGGT
TTATCATCAGAGATCCTCCGTTTGGTTCCTCTTCTTTGGAGTTTCATAACGAAACTTTTCGGCAAG
GAAGATGACAAGAATTTGAGGTTCCTTCAACTCCTTTCTGCCAAGAAATCCCAAGGATTCTATTT
TTTGGACTCCTCGGTATAACTTACTTCTTCCTTTCGCCATTGATACTGCCTTTCTTGTTGGTCTAC
TATTGTCTTGGATATATCATCTACCGCAACCAGCTCCTAAACGTATATGCGGCCAAGTATGAAACT
GGTGGAAAGTTTTGGCCAATAGTTCACAGCTATACTATCTTCTCTTTGGTACTAATGCACATTATT
GCAGTCGGATTATTCGGGCTTAAAGAGCTTCCAGTGGCATCTTCTTTAACAATTCCCCTTCCGGTT
CTCACGGTCCTTTTCAGCATTTACTGCCAAAGACGGTTTTTACCAAATTTCAAATCTTATCCTACC
CAGTGTCTGGTAAACAAAGATAAAGCAGACGAGAGAGAGCAAAACATGTCTGAATTCTATTCGGAA
CTCGTTGTTGCTTACCGAGATCCTGCACTTTCGGCATCACAGGACTCGAGAGATATCTCACCTTGA
```

SEQ ID NO: 445, protein - Arabidopsis thaliana
MLLSALLTSVGINLGLCFLFFTLYSILRKQPSNVTVYGPRLVKKDGKSQQSNEFNLERLLPTAGWV
KRALEPTNDEILSNLGLDALVFIRVFVFSIRVFSFASVVGIFILLPVNYMGTEFEEFFDLPKKSMD
NFSISNVNDGSNKLWIHFCAIYIFTAVVCSLLYYEHKYILTKRIAHLYSSKPQPQEFTVLVSGVPL
VSGNSISETVENFFREYHSSSYLSHIVVHRTDKLKVLMNDAEKLYKKLTRVKSGSISRQKSRWGGF
LGMFGNNVDVVDHYQKKLDKLEDDMRLKQSLLAGEEVPAAFVSFRTRHGAAIATNIQQGIDPTQWL
TEAAPEPEDVHWPFFTASFVRRWISNVVVLVAFVALLILYIVPVVLVQGLANLHQLETWFPFLKGI
LNMKIVSQVITGYLPSLIFQLFLLIVPPIMLLLSSMQGFISHSQIEKSACIKLLIFTVWNSFFANV
LSGSALYRVNVFLEPKTIPRVLAAAVPAQASFFVSYVVTSGWTGLSSEILRLVPLLWSFITKLFGK
EDDKEFEVPSTPFCQEIPRILFFGLLGITYFFLSPLILPFLLVYYCLGYIIYRNQLLNVYAAKYET
GGKFWPIVHSYTIFSLVLMHIIAVGLFGLKELPVASSLTIPLPVLTVLFSIYCQRRFLPNFKSYPT
QCLVNKDKADEREQNMSEFYSELVVAYRDPALSASQDSRDISP

SEQ ID NO: 446, DNA - Arabidopsis thaliana
```
ATGGCGACACTAACCGATATCGGAGTCGCAGCAACGATCAATATTCTAACCGCATTTGCTTTCTTC
ATTGCCTTTGCGATACTTAGACTTCAACCAGTTAACGACAGAGTCTATTTCCCTAAATGGTATCTC
AAGGGTTTAAGAAGTAGTCCTATAAAAACAGGTGGCTTTGCTAGCAAGTTTGTCAATTTGGATTTT
CGATCTTACATCAGATTCTTGAATTGGATGCCTCAAGCTTTGAGAATGCCTGAGCCTGAACTTATT
GATCATGCTGGTTTGGATTCTGTTGTCTATCTCAGGATTTACTTACTCGGGTTGAAGATCTTTTTT
CCTATAGCATGTATTGCTTTCACTGTAATGGTACCGGTTAATTGGACTAACTCGACGTTGGATCAG
TTAAAGAATCTAACTTTTAGTGATATTGATAAACTCTCTATATCGAATATACCAACTGGATCATCC
AGGTTTTGGGTGCATTTGTGTATGGCTTATGTTATTACCTTTTGGACTTGCTTTGTCCTACAACGA
GAGTACAAGCATATTGCTTCCATGAGGCTACAGTTTCTTGCTTCTGAGCATAGGAGACCTGACCAG
TTTACTGTTCTTGTAAGGAACATTCCTCCAGATCCTGATGAATCAGTAAGTGAGCTCGTTGAGCAT
```

FIGURE 24 (continued)

TTCTTTAAGGTCAACCATCCAGACTACTACCTCACTTACCAGGCGGTCTACAACGCAAACAAGCTG
TCGGAACTGGTACAGAAGAGGATGAAATTGCAGAATTGGCTTGATTACTATCAAAACAAACACTCT
AGGAATCCATCTAAAAGGCCTTTAATAAAGATTGGTTTCCTTGGCTGTTGGGGTGAAGAAGTTGAT
GCAATTGATCACTACATAGAAAAAATCGAGGGTCTAACGAGAAAAATAAGTGAAGAGAAAGAGACA
GTAATGAGCAGCACAAAATCACTCGTACCTGCAGCTTTTGTATCCTTCAAAAAGCGTTGGGGCGCT
GTTGTTTGCTCTCAAACTCAACAGTCTCGAAACCCGACAGAGTGGCTAACCGAGTGGGCTCCAGAG
CCGCGAGACATATACTGGGACAATCTAGCATTACCATATGTTCAGCTCACAATCCGGAGACTAGTA
ATAGCTGTAGCTTTCTTCTTCCTCACTTTCTTCTTCATGATCCCTATAGCTTTCGTACAGACACTC
GCCAATATCGAAGGCATCGAAAAGGCTGTTCCGTTCTTGAAACCGCTTATCGAAGTGAAAACTGTA
AAGTCATTTATCCAAGGTTTTCTTCCGGGTATCGCATTGAAGATATTCCTCATTGTCCTCCCAAGT
ATACTAATGCTAATGTCGAAGTTCGAAGGCTTCATAAGCAAATCTTCACTAGAAAGAAGGTGTGCA
AGCAGATACTACATGTTCCAGTTCATCAACGTTTTCCTCTGTAGCATAATCGCGGGAACTGCGCTT
CAACAACTTGACAGCTTCCTAAACCAATCTGCAACCGAAATACCGAAGACAATTGGTGTCTCGATA
CCAATGAAAGCCACTTTCTTTATCACCTACATAATGGTAGACGGATGGGCTGGTGTTGCTGGAGAG
ATACTGAGGTTAAAGCCATTGATAATATATCATCTCAAGAACTTCTTCCTTGTGAAAACAGAGAAG
GACAGAGAAGAAGCAATGGATCCTGGAACCATAGGTTTCAATACTGGTGAACCTCAGATACAACTC
TACTTCATTCTTGGTCTAGTTTACGCCGCTGTTAGCCCCATTCTCCTTCCTTTTATCCTCGTCTTC
TTCGCCTTAGCTTACGTGGTTTACCGTCATCAGATTATAAATGTGTATAACCAAGAGTATGAGAGT
GCTGCAGCGTTCTGGCCAGATGTTCATAGACGTGTAGTGATTGCACTGATCGTATCTCAGCTTCTT
TTGATGGGATTGCTTAGCACGAAAAAAGCTGCTCGTTCGACTCCATTGCTTTTCATACTTCCTGTG
TTAACCATTGGATTCCACAAATTCTGTCAAGGACGTTACCAACCTATATTTGTCACATACCCTTTA
CAGGATGCAATGGTTAAAGATACGTTGGAACGCATGAGAGAACCGAATTTAAACTTGAAAACGTTT
CTTCAAAACGCGTATGCACATCCGGTGTTTAAAGCTGCAGATAATCTAGCTAATGAGATGGTTGTG
GAGGAGCCAGCGCCCGATAAGACGCCGGATTTAGTGGCGACTAAACGTGGCTCAAGGAGGTTTAAT
AGCGGCTCTGCTGAAACCTTTACTTAG

SEQ ID NO: 447, protein - Arabidopsis thaliana
MATLTDIGVAATINILTAFAFFIAFAILRLQPVNDRVYFPKWYLKGLRSSPIKTGGFASKFVNLDF
RSYIRFLNWMPQALRMPEPELIDHAGLDSVVYLRIYLLGLKIFFPIACIAFTVMVPVNWTNSTLDQ
LKNLTFSDIDKLSISNIPTGSSRFWVHLCMAYVITFWTCFVLQREYKHIASMRLQFLASEHRRPDQ
FTVLVRNIPPDPDESVSELVEHFFKVNHPDYYLTYQAVYNANKLSELVQKRMKLQNWLDYYQNKHS
RNPSKRPLIKIGFLGCWGEEVDAIDHYIEKIEGLTRKISEEKETVMSSTKSLVPAAFVSFKKRWGA
VVCSQTQQSRNPTEWLTEWAPEPRDIYWDNLALPYVQLTIRRLVIAVAFFFLTFFFMIPIAFVQTL
ANIEGIEKAVPFLKPLIEVKTVKSFIQGFLPGIALKIFLIVLPSILMLMSKFEGFISKSSLERRCA
SRYYMFQFINVFLCSIIAGTALQQLDSFLNQSATEIPKTIGVSIPMKATFFITYIMVDGWAGVAGE
ILRLKPLIIYHLKNFFLVKTEKDREEAMDPGTIGFNTGEPQIQLYFILGLVYAAVSPILLPFILVF
FALAYVVYRHQIINVYNQEYESAAAFWPDVHRRVVIALIVSQLLLMGLLSTKKAARSTPLLFILPV
LTIGFHKFCQGRYQPIFVTYPLQDAMVKDTLERMREPNLNLKTFLQNAYAHPVFKAADNLANEMVV
EEPAPDKTPDLVATKRGSRRFNSGSAETFT

SEQ ID NO: 448, DNA - Arabidopsis thaliana
ATGTGCAGAATTAGATTCTTCCTGATGTGTTCGTTACTTGGAGCATCACTACTTCTTCCGGTTGAT
TATTACAATGAGTCAGATTTACCGACACGAAGAGTATTCAATGGATGCTTTCACAATATCAAAT
ATCACACGAGGTTCTAACAAGTTATGGGTGCATTTCATGCTTGTGGTGCATATCATTCTATGCA
TTGTTTTGTTGCATAAGGAATATAAGGAGATTCTTGTGATAAGGCTTCAACAAATGAAAGAACTT
AGACATCGTGCTGATCAGTTCACTGTTCTTGTCCGCCAAGTTCCTCTCTGCCCTGAGCATAACACT
CGTGGCTGCGCCGTTGATCACTTTTTCTCTAAGCATCATCGCTTTAGTTATCATTCACATCAGATG
TTGTATGACGGGAGAGATCTTGAATACCTTTTGGGGAAGCAGAAGAAGCTTAAGAAAGAGCTAGAA

```
GACAAGAGACACACAGAAATACTTTCAAATGGATCACAAGAACACAAGCAAATATCCACATCTGAA
GAAAAACTTCGAGAAATTACTCATATGATTTACCACCTTCAAAGTGAAACTATGCTCAGAGAGAAG
GAGTTACCTGTTGCGTTTGTCACCTTCAAATCCCGAAGAAATGCCGCGTTGGCAGCTCAAACACAG
CAGCACTCAAATCCTCTAGAACTGATAACTGAAATGGCTCCTGAACCAAGAGATGTATCCTGGAGA
AATCTTGCTATTCCACAAAGATTTTGCCTCTCAACAAGATCGGAGTCATCCTTGCAGCAGCACTT
CTTACAATCTTCTTTGCTATTCCGGTCACAGCTGTCCAGGGAATTGCAAAGTATGAGAAGCTTAAG
AAATGGTTTCCTCCAGCCATGGCTATTGAATTCATACCAGGGCTTAGCTCAGTTGTGACAGGTTAC
CTCCCAAGTGCTATACTCAAAGGTTTCATGTACATTATTCCTTTCGCTATGCTTGGACTGGCCTAT
CTCGGCGGCTCTATTTCCAACAGTAAAGAGGAGATAAAAGCTTGCAACATGGTCTTCTATTTTCTA
ATGGGAAATGTTTTCTTCTTGAGTCTTATCTCTGGTTCCTTGCTTGATGAAATAGGAGAATATCTC
ACTCATCCTAGAGACATTCCTAGTCACCTTGCTGCTGCTGTTTCAGCCCAGGCAGAGTTTTTTATG
ACATACATCTTGACAGATGGGCTGTCTGGATTTTCTTTGGAGATTCTTCAATTGGGACTTATACTA
TTTGATATCATAAGATCATACACTTATGGAAGAGGAAAAGAGAGAACTCCTTACCTCTTTTCATTT
CCATATTTTAGAGTTATCCCCACAGTTTCCTTATCGATAATGATCGGTATGATTTATGCGGTGGTT
GCGCCATTGATGCTCCCTTTCCTAGTTGGTTATTTCTGCCTTGGATACATTGTCTACTTCAATCAG
ATGGAGGATGTTTACGAGACTACATATGATACTTGCGGTCGATTCTGGCCATTCATTCATCATTAT
ATATTTGTCTCAATAATACTAATGCAAATCACAATGGTGGGTCTTTTGGACTTAAATCAAAGCCA
TCTGCAGCAATTGCTACAGTACCTCTCATATTGATCACTATAGCTTATAACGAATACTGCAAGATC
CGCTTCCTCCCATCATTTAAACATTTCCCTATACAGACAGCAGTTGAAATAGACGAAGAAGATGAA
AAGAATGGGGAGATGGAAACACATTATGTTGATGCTGCAACGGCGTATAACCGGCATCAACCTTGC
TTAGAGCGTGTAAGCTCAGCGGAATCACCAACAAACTTAAGCCAACCATTGCTTGGGACAGACTCC
ATTTGA
```

SEQ ID NO: 449, protein - Arabidopsis thaliana
MCRIRFFLMCSLLGASLLLPVDYYNESDLPTRREYSMDAFTISNITRGSNKLWVHFSCLWCISFYA
LFLLHKEYKEILVIRLQQMKELRHRADQFTVLVRQVPLCPEHNTRGCAVDHFFSKHHRFSYHSHQM
LYDGRDLEYLLGKQKKLKKELEDKRHTEILSNGSQEHKQISTSEEKLREITHMIYHLQSETMLREK
ELPVAFVTFKSRRNAALAAQTQQHSNPLELITEMAPEPRDVSWRNLAIPQKILPLNKIGVILAAAL
LTIFFAIPVTAVQGIAKYEKLKKWFPPAMAIEFIPGLSSVVTGYLPSAILKGFMYIIPFAMLGLAY
LGGSISNSKEEIKACNMVFYFLMGNVFFLSLISGSLLDEIGEYLTHPRDIPSHLAAAVSAQAEFFM
TYILTDGLSGFSLEILQLGLILFDIIRSYTYGRGKERTPYLFSFPYFRVIPTVSLSIMIGMIYAVV
APLMLPFLVGYFCLGYIVYFNQMEDVYETTYDTCGRFWPFIHHYIFVSIILMQITMVGLFGLKSKP
SAAIATVPLILITIAYNEYCKIRFLPSFKHFPIQTAVEIDEEDEKNGEMETHYVDAATAYNRHQPC
LERVSSAESPTNLSQPLLGTDSI

SEQ ID NO: 450, DNA - Arabidopsis thaliana
```
ATGGCTTCAGTACAAGATATTGGTCTATCAGCAGCTATAAATCTATTATCTGCATTTGCTTTCTTG
TTTGCATTTGCTATGCTTAGACTTCAGCCAGTTAACGATAGAGTTTACTTCCCAAAATGGTATCTC
AAAGGGATAAGAGGAAGTCCAACGCGTTCTAGAGGAATCATGACTAGATTTGTTAATTTAGATTGG
ACTACTTATGTCAAGTTTCTTAATTGGATGCCTGCTGCTCTTCAAATGCCTGAACCTGAGCTTATA
GAACATGCAGGCCTTGACTCTGCTGTATATATCCGCATTTACCTTCTTGGATTGAAATGTTCGTT
CCGATAACACTACTTGCTTTTGGAGTTTTGGTTCCTGTCAATTGGACTGGAGAAACTCTAGAAAAT
ATCGATGACTTGACATTCAGTAACGTCGATAAGCTGTCAATATCAAATGTTCCACCAGGATCGCCG
AGGTTTTGGGCACATATAACTATGACATACGTGATTACATTCTGGACTTGCTACATATTATATATG
GAATATAAGCTGTGGCTAATATGAGATTGAGACATCTAGCAGCAGAAAGTCGTCGTCCTGATCAA
CTCACTGTACTTGTAAGAAATGTTCCTCCAGATCCTGATGAATCAGTAAACGAGCATGTTGAGCAC
TTCTTTTGTGTAAATCATCCAGATCATTATCTTTGCCATCAGGTAGTGTACAATGCAAATGACCTT
GCAAAATTAGTCGCACAGAGAAAAGCTATGCAAATTGGTTGACGTACTACGAGAATAAATTCGAG
```

FIGURE 24 (continued)

```
AGGAAGCCATCAAGTAGACCAACAACAAAGACAGGTTATGGAGGTTTTTGGGGAACTACAGTTGAT
GCAATTGACTTCTACACTTCAAAGATGGATATTCTGGCTGAGCAAGAAGCTGTAGAAAGAGAAAAG
ATCATGAACGATCCTAAGGCTATCATGCCGGCAGCATTTGTTTCCTTCAGATCACGGTGGGGAACA
GCTGTTTGTGCTCAAACACAGCAATGCCACAATCCCACAATCTGGTTGACGGAATGGGCTCCCGAA
CCACGCGATGTTTTCTGGGATAATCTCGCTATTCCATATGTTGAGCTCTCAATAAGAAGATTGCTC
ACAACAGTTGCACTGTTTTTTCTTATTTTCTGCTTCATGATTCCTATAGCATTTGTTCAGTCTCTT
GCCAACCTTGAAGGGATCCAAAAAGTTCTCCCTTTCTTGAAACCCGTGATAGAAATGAAGACTGTA
AAGTCTGTAATCCAAGGGTTTCTTCCAGGAATAGCGTTAAAGATTTTTCTCATCATACTTCCAACT
ATTCTGATGACAATGTCACAAATTGAAGGATATACATCGCTGTCCTATTTAGATAGAAGATCAGCT
GAAAAGTATTTCTGGTTCATTATTGTCAATGTCTTTCTTGGAAGCATCATTACCGGGACAGCGTTT
CAGCAGCTTAAATCTTTCCTTGAGCAACCACCAACCGAGATCCCGAAAACAGTTGGTGTGTCAATC
CCAATGAAGGCCACATTTTTCATCACATATATCATGGTCGATGGTTGGGCTGGCATAGCAGCTGAG
ATACTCAGAGTGGTTCCATTAGTCATCTTTCACCTGAAAAACACGTTTTTGGTTAAGACAGAACAA
GACAGGCAGCAAGCAATGGATCCAGGTCATCTGGACTTTGCAACATCTGAACCACGGATTCAGTTC
TATTTCTTGCTAGGCCTCGTATACGCTGCTGTTGCGCCAATTCTCCTTCCATTCATTATCGTCTTC
TTTGCTTTCGCATACGTTGTTTTTCGGCATCAGGTTATTAATGTCTACGACCAGAAATATGAGAGC
GGGGCTAGATACTGGCCTGACGTGCATAGACGTTTGATCATATGTCTAATAATATCACAGCTTCTG
ATGATGGGTCTGCTCAGCACAAAGAAATTTGCAAAAGTAACAGCTCTGCTTCTCCCTCAGCCTATC
TTAACCTTTTGGTTTTACAGATACTGCGCAGGACGGTTTGAATCGGCCTTCTCAAAATTTCCTTTA
CAGGAAGCAATGGTGAAGGATACACTAGAAAAGCAACTGAACCGAATCTAAACCTCAAGGAATAT
CTGAAAGATGCTTACGTGCATCCGGTTTTTAAAGGCAATGATTTTGACCGACCACGGGTAGTCGAT
GAGGAGGAAAGTAACCCTCTTGTAAGGACCAAGAGGACTTCTCAAGGTACGACCCGATACAACTCA
GAAGCTAGTAGCTCTGCTACAACCACTCCTGTAGCCAACAATGACTCTCCTAGATGTTGGGGTACA
AAAATTGGGTCCTTTGGATGTGTAATTGTTGTTTCATACAGTTGTTAG
```

SEQ ID NO: 451, protein - Arabidopsis thaliana
```
MASVQDIGLSAAINLLSAFAFLFAFAMLRLQPVNDRVYFPKWYLKGIRGSPTRSRGIMTRFVNLDW
TTYVKFLNWMPAALQMPEPELIEHAGLDSAVYIRIYLLGLKMFVPITLLAFGVLVPVNWTGETLEN
IDDLTFSNVDKLSISNVPPGSPRFWAHITMTYVITFWTCYILYMEYKAVANMRLRHLAAESRRPDQ
LTVLVRNVPPDPDESVNEHVEHFFCVNHPDHYLCHQVVYNANDLAKLVAQRKAMQNWLTYYENKFE
RKPSSRPTTKTGYGGFWGTTVDAIDFYTSKMDILAEQEAVEREKIMNDPKAIMPAAFVSFRSRWGT
AVCAQTQQCHNPTIWLTEWAPEPRDVFWDNLAIPYVELSIRRLLTTVALFFLIFCFMIPIAFVQSL
ANLEGIQKVLPFLKPVIEMKTVKSVIQGFLPGIALKIFLIILPTILMTMSQIEGYTSLSYLDRRSA
EKYFWFIIVNVFLGSIITGTAFQQLKSFLEQPPTEIPKTVGVSIPMKATFFITYIMVDGWAGIAAE
ILRVVPLVIFHLKNTFLVKTEQDRQQAMDPGHLDFATSEPRIQFYLLGLVYAAVAPILLPFIIVF
FAFAYVVFRHQVINVYDQKYESGARYWPDVHRRLIICLIISQLLMMGLLSTKKFAKVTALLLPQPI
LTFWFYRYCAGRFESAFSKFPLQEAMVKDTLEKATEPNLNLKEYLKDAYVHPVFKGNDFDRPRVVD
EEESNPLVRTKRTSQGTTRYNSEASSSATTTPVANNDSPRCWGTKIGSFGCVIVVSYSC
```

SEQ ID NO: 452, DNA - Arabidopsis thaliana
```
ATGGCAACACTTAAAGACATTGGTGTATCAGCAGGGATAAACATCCTCACTGCATTCATTTTCTTC
ATAATCTTTGCGTTTTTAAGGCTTCAGCCATTCAACGACAGAGTTTACTTCTCCAAATGGTACCTC
AGGGGGTTAAGAAGCAGCCCTGCAAGTGGCGGCGGATTCGCGGGCGGTTTGTGAATTTGGAGTTG
AGATCATACCTCAAGTTCTTGCATTGGATGCCTGAAGCTCTTAAGATGCCTGAGCGTGAGCTGATT
GATCATGCTGGTTTAGACTCTGTTGTCTATCTCCGGATTTACTGGCTCGGGCTTAAGATTTTTGCT
CCAATAGCAATGCTTGCTTGGGCAGTTCTTGTACCGGTTAATTGGACAAACAACGAGTTGGAGTTG
GCTAAGCATTTTAAGAATGTGACTTCAAGTGATATTGACAAACTAACAATTTCGAATATCCCAGAA
GGTTCAAATAGGTTTTGGGCTCATATCATAATGGCTTATGCCTTTACAATCTGGACTTGTTATATG
```

FIGURE 24 (continued)

```
CTGATGAAGGAGTATGAGACAGTTGCTAACATGAGGCTTCAGTTTCTTGCCTCAGAAGGCCGTCGA
CCTGACCAGTTCACTGTTCTTGTTAGGAATGTACCTCCGGACCCAGACGAAACTGTGAGTGAGCTT
GTGGAGCATTTTTTCCTAGTTAATCACCCTGATAACTACCTCACACATCAGGTTGTATGCAATGCA
AACAAGCTCGCGGATTTGGTTAGTAAAAAGACGAAGCTGCAGAACTGGCTTGACTATTATCAGCTC
AAATACACTAGAAATAATTCTCAGATCAGACCTATAACGAAGCTTGGGTGCCTTGGCTTGTGTGGA
CAAAAAGTTGACGCAATCGAACATTACATTGCTGAAGTAGATAAAACATCAAAAGAGATTGCTGAA
GAGAGAGAGAATGTGGTGAATGATCAAAAGTCAGTCATGCCAGCATCTTTTGTCTCTTTCAAAACC
CGTTGGGCTGCTGCTGTTTGCGCTCAGACCACGCAGACCCGAAACCCAACTGAATGGTTAACCGAA
TGGGCTGCAGAGCCGCGTGATATATATTGGCCAAACCTAGCGATTCCATATGTTTCTTTGACTGTG
AGAAGATTGGTTATGAATGTAGCCTTCTTCTTCCTTACCTTCTTTTTCATCATCCCTATCGCGTTT
GTACAATCTCTTGCTACCATTGAAGGAATTGAGAAAGTTGCACCGTTCTTGAAAGTCATTATCGAA
AAAGATTTCATAAAATCGCTGATACAAGGTTTGCTAGCCGGTATTGCGTTGAAGCTTTTCCTCATC
TTTCTGCCAGCCATACTGATGACCATGTCCAAATTTGAAGGCTTTACTTCAGTTTCATTCTTAGAA
AGACGATCCGCGTCTAGATATTACATCTTTAACTTAGTGAACGTCTTTCTTGGAAGTGTTATCGCT
GGAGCTGCGTTTGAGCAGCTTAACTCTTTCCTCAATCAATCGCCTAATCAAATCCCTAAGACTATT
GGCATGGCGATACCGATGAAAGCAACCTTCTTTATCACATATATAATGGTTGATGGTTGGGCAGGA
GTTGCAGGAGAGATTCTTATGTTGAAACCTCTCATTATATACCACCTCAAAAACGCATTCTTGGTG
AAAACAGAGAAAGACAGAGAGGAAGCAATGAACCCGGGAAGCATCGGTTTCAACACTGGAGAGCCT
CAGATACAGCTTTACTTCCTTCTTGGTCTTGTCTATGCTCCTGTGACACCAATGCTTCTTCCTTTT
ATCTTAGTCTTTTTCGCTCTTGCTTATGTCGTATACCGCCATCAGATCATAAATGTGTATAATCAA
GAGTATGAGAGCGCTGCTGCGTTTTGGCCGGATGTTCATGGACGGGTTATAACGGCATTGATCATA
TCTCAGTTGCTTCTGATGGGTTTGTTAGGTACAAAACATGCCGCTTCAGCTGCTCCGTTTCTCATT
GCTCTTCCTGTGATTACTATCGGTTTCCACCGCTTCTGTAAAGGCCGTTTCGAACCTGCCTTTGTC
CGTTACCCCTTACAGGAAGCTATGATGAAAGATACATTGGAAAGAGCAAGAGAGCCAAATCTGAAC
CTGAAAGGTTACTTGCAAGACGCTTATATTCATCCGGTTTTTAAAGGCGGTGATAATGATGACGAC
GGTGACATGATCGGAAAATTGGAGAATGAAGTCATCATAGTGCCAACAAAACGCCAATCGCGGAGG
AACACTCCTGCACCGAGCAGAATCAGCGGTGAATCGTCTCCATCTTTGGCCGTTATTAACGGTAAA
GAAGTCTAG
```

SEQ ID NO: 453, protein - Arabidopsis thaliana
```
MATLKDIGVSAGINILTAFIFFIIFAFLRLQPFNDRVYFSKWYLRGLRSSPASGGGFAGRFVNLEL
RSYLKFLHWMPEALKMPERELIDHAGLDSVVYLRIYWLGLKIFAPIAMLAWAVLVPVNWTNNELEL
AKHFKNVTSSDIDKLTISNIPEGSNRFWAHIIMAYAFTIWTCYMLMKEYETVANMRLQFLASEGRR
PDQFTVLVRNVPPDPDETVSELVEHFFLVNHPDNYLTHQVVCNANKLADLVSKKTKLQNWLDYYQL
KYTRNNSQIRPITKLGCLGLCGQKVDAIEHYIAEVDKTSKEIAEERENVVNDQKSVMPASFVSFKT
RWAAAVCAQTTQTRNPTEWLTEWAAEPRDIYWPNLAIPYVSLTVRRLVMNVAFFFLTFFFIIPIAF
VQSLATIEGIEKVAPFLKVIIEKDFIKSLIQGLLAGIALKLFLIFLPAILMTMSKFEGFTSVSFLE
RRSASRYYIFNLVNVFLGSVIAGAAFEQLNSFLNQSPNQIPKTIGMAIPMKATFFITYIMVDGWAG
VAGEILMLKPLIIYHLKNAFLVKTEKDREEAMNPGSIGFNTGEPQIQLYFLLGLVYAPVTPMLLPF
ILVFFALAYVVYRHQIINVYNQEYESAAAFWPDVHGRVITALIISQLLLMGLLGTKHAASAAPFLI
ALPVITIGFHRFCKGRFEPAFVRYPLQEAMMKDTLERAREPNLNLKGYLQDAYIHPVFKGGDNDDD
GDMIGKLENEVIIVPTKRQSRRNTPAPSRISGESSPSLAVINGKEV
```

SEQ ID NO: 454, DNA - Arabidopsis thaliana
```
ATGGCTACAATAAACGATATTGGAGTAGCAGCAGCAATCAATATAGTCACAGCATTTGCTTTTCTC
TTAGCTTTTGCTATATTCAGGATTCAACCAGTAAATGACAGAGTCTATTTCCCTAAATGGTATCTC
AAGGGCTTAAGAAGTAGTTCTATACAAACTGGTGGCTTTGGTAGCAAATTCATCAATTTGGACTTC
AGGTCCTATATTCGTTTCCTCAATTGGATGCCTGAAGCACTTAAAATGCCAGAACCGGAACTCGTC
```

FIGURE 24 (continued)

```
GATCACGCTGGACTCGATTCTGTTGTCTACTTGAGGATCTACTTACTCGGGCTCAAGATCTTTTTC
CCTATAGCTTGTGTTGCTTTTACAACAATGGTTCCTGTTAATTGGACAAACAAAGGATTGGATCGG
TTAAGGCATTCCAATATAAGTTTCAGTGATATTGATAAACTCTCTTTATCAAATATACCAAATGGG
TCACCTAGATTTTGGGTGCATTTGTGTATGGCTTATGCGATTACCTTCTGGACATGCTTTATCCTG
AAAAGAGAGTACCAGAATATAGCTTTAATGAGACTACAGTTTCTTGCAAATGATCAAAGGAGACCT
AACCAGTTCACTGTACTGGTAAGAAACATTCCTGCAGATCCTCATGAATCAATATGTGAACTTGTT
GAACATTTCTTCAAAGTCAATCATCCAGATCACTATCTCACTTTCCAGGCAGTCCACGATGCAACC
AAACTCTCGGAATTGGTTCTGACGAGGAAACAAATGCAGAACCTGCTTGATTACAATATAAACAAA
CACATGAGGAATCTATCTAACAGGCCAGTAATAAAGATGGGATTTCTTGGCTGCTGTGGTGAAGAA
GCTGATGGAATCAAATATTACACGTCCGTCGTTGAGGGTCTAACAAGAGAAATATCTGAGGAGAAA
CAGAGGTTAAGGACCGGCACAAAGTCCATAGTGCCTGCAGCTTTTGTATCTTTCAAGAGCCGTTGG
GGAGCAGCGGTTTGTGCTCAAACTCAACAGACAAGAAACCCAACAGAATGGCTAACTGAGTGGGCT
GCAGAGCCACGTGACATCTACTATGACAATCTGGCATTGCCATATGTAGACCTTAAGATAAGGAGG
CTCATAGTCGGCGTCGCATACTTCTTCCTCACCTTCTTCTTCATGATACCAATAGCATTTGTACAG
TCACTCGCCAACATCGAAGGCATAGAGAAGGCTTTTCCTTTCTTGAAGCCCCTTATAGAAGTGAAA
TTGTTAAAGTCGATCATCCAAGGTTTCCTTCCCGGAATCGCCTTGAAGATCTTCCTCCTTTTCCTC
CCAAGAATACTCATGCAGATGTCCAAATTTGAAGGTTTTGTCAGCACATCCTCATTAGAAAGAAGA
GCTGCAACTAGATTCTACATGTTCCAATTCATCAATGTTTTCCTTGGAAGCATAGTCACCGGGACT
GCGTTTCAACAGCTCAACAGTTTCCTTAACCAGTCTGCAAACGATATTCCAAAAACAATTGGTGTC
TCGATTCCAATGAAAGCGACCTTCTTTATAACATACATAATGGTGGATGGATGGGCTGGTGTTGCT
GGTGAGATATTGAGGTTGAAGCCACTCATAATCTATCATCTAAAGAACTCCTTCCTCGTGAGAACC
GAAAAAGATAGGGAAGAAGCAACTGATCCTGGAACCATAGGATTCAACACTGGTGAGCCTCAAATA
CAACTCTACTTCCTTCTTGGTCTTGTTTACGCAGCAGTTAGCCCCATCCTTCTCCCTTTTATCCTC
GTCTTCTTCGGCCTGGCTTTTGTAGTGTACCGTCATCAGGTTATAAATGTGTATAACCAAAAGTAT
GAGAGCGCAGGGAAGTTCTGGCCTGACGTTCACAGGCGTGTTGTGACCGCATTGGTTGTTTCACAG
CTGCTCTTGATGGGTCTTCTAAGCACCAAACACGCTTCTAAGTCCACTCCTTTGCTGCTTGTGCTT
CCGTTGCTGACCATCGGGTTCCACAAACACTGCAAAAACCGTTACCAACCTGCCTTTGTCACATAC
CCGTTACAGCAGGAAGCCATGATCAAAGATACACTGGACCGTATACGTGAACCAAACTTAAACCTC
AAAGCTTTCCTTCGAGACGCCTACGCCCACCCGGAGTTCAGGGTTGGAGAAGATCCAGAGCCCGAG
GAGAAGCTGGAGTCTGATATGTCACCTCCGGATTTAGTGGCCACTAAGCGTTGGTCATGGAGGAAC
ACTCCTTTGCCTAGCAAAGATAGCTGCCGTGAAATACCCTAA
```

SEQ ID NO: 455, protein - Arabidopsis thaliana
```
MATINDIGVAAAINIVTAFAFLLAFAIFRIQPVNDRVYFPKWYLKGLRSSSIQTGGFGSKFINLDF
RSYIRFLNWMPEALKMPEPELVDHAGLDSVVYLRIYLLGLKIFFPIACVAFTTMVPVNWTNKGLDR
LRHSNISFSDIDKLSLSNIPNGSPRFWVHLCMAYAITFWTCFILKREYQNIALMRLQFLANDQRRP
NQFTVLVRNIPADPHESICELVEHFFKVNHPDHYLTFQAVHDATKLSELVLTRKQMQNLLDYNINK
HMRNLSNRPVIKMGFLGCCGEEADGIKYYTSVVEGLTREISEEKQRLRTGTKSIVPAAFVSFKSRW
GAAVCAQTQQTRNPTEWLTEWAAEPRDIYYDNLALPYVDLKIRRLIVGVAYFFLTFFFMIPIAFVQ
SLANIEGIEKAFPFLKPLIEVKLLKSIIQGFLPGIALKIFLLFLPRILMQMSKFEGFVSTSSLERR
AATRFYMFQFINVFLGSIVTGTAFQQLNSFLNQSANDIPKTIGVSIPMKATFFITYIMVDGWAGVA
GEILRLKPLIIYHLKNSFLVRTEKDREEATDPGTIGFNTGEPQIQLYFLLGLVYAAVSPILLPFIL
VFFGLAFVVYRHQVINVYNQKYESAGKFWPDVHRRVVTALVVSQLLLMGLLSTKHASKSTPLLLVL
PLLTIGFHKHCKNRYQPAFVTYPLQQEAMIKDTLDRIREPNLNLKAFLRDAYAHPEFRVGEDPEPE
EKLESDMSPPDLVATKRWSWRNTPLPSKDSCREIP
```

FIGURE 24 (continued)

SEQ ID NO: 456, DNA - Arabidopsis thaliana
ATGGCGACACTTCAGGATATTGGTGTATCAGCTGGGATAAACATTCTCAGTGCCTTTGTTTTCTTC
ATAATCTTTGCGGTTTTGAGGCTTCAGCCTTTCAATGATAGAGTTTACTTCTCAAAATGGTATCTC
AAGGGGTTAAGAAGCAGCCCTGCTCGTGGTGGCGCCTTTGCGCAGAGGTTTGTGAACCTGGACTTC
AGGTCTTATATGAAGTTCTTGAATTGGATGCCAGAGGCTCTGAAGATGCCTGAGCCTGAGCTTATT
GATCATGCTGGTTTGGATTCAGTTGTTTATCTCCGGATTTACTGGCTGGGCTTAAGATCTTTACT
CCAATAGCAGTGCTTGCTTGGGCAGTTCTTGTGCCAGTCAACTGGACTAATAACACATTGGAGATG
GCTAAGCAGTTAAGGAATGTAACTTCGAGCGACATTGACAAACTCTCTGTTTCAAATATTCCAGAG
TATTCAATGAGGTTTTGGACTCATATAGTAATGGCTTATGCCTTTACCATCTGGACTTGTTATGTG
CTGATGAAAGAATATGAGACAATTGCTAACATGAGGCTCCAGTTTGTTGCATCAGAAGCTCGTCGA
CCTGACCAGTTCACTGTCCTTGTTAGGAATGTACCTCCGGACGCAGATGAATCTGTAAGTGAACTG
GTAGAGCATTTTTTCCTGGTCAATCATCCTGATCACTACCTAACACATCAGGTTGTATGCAATGCA
AACAAGCTGGCCGATTTGGTGAAAAAGAAGAAAAAGCTGCAGAATTGGCTTGATTACTACCAGCTC
AAATACGCTAGGAATAACTCTCAGAGAATTATGGTGAAGCTTGGCTTTCTTGGGCTATGGGGACAA
AAAGTCGATGCCATTGAACATTACATTGCTGAAATTGACAAAATATCAAAAGAGATCAGTAAAGAA
AGAGAGGAAGTGGTGAATGATCCTAAGGCCATTATGCCAGCAGCGTTTGTCTCCTTTAAAACACGA
TGGGCTGCTGCGGTTTGTGCTCAGACTCAACAGACCCGAAACCCAACCCAATGGCTGACCGAATGG
GCTCCAGAACCGCGTGATGTGTTTTGGTCAAATCTTGCTATTCCATATGTTTCTCTGACAGTAAGG
AGGTTGATCATGCATGTTGCCTTCTTCTTCCTAACCTTCTTCTTCATTGTCCCCATCGCGTTTGTT
CAATCTCTTGCTACCATTGAAGGGATTGTGAAAGCTGCTCCGTTCTTGAAGTTTATTGTAGATGAT
AAATTCATGAAATCGGTGATACAAGGTTTCCTTCCGGGTATTGCACTGAAGCTTTTCCTCGCCTTT
CTGCCATCCATTTTGATGATCATGTCCAAATTTGAAGGCTTCACATCGATCTCATCTTTAGAGAGA
CGAGCAGCGTTTCGATATTACATCTTCAACTTAGTGAACGTCTTTCTTGCTAGCGTTATCGCTGGA
GCTGCGTTTGAACAGCTTAACTCTTTCCTCAATCAATCCGCAAACCAAATCCCCAAAACCATTGGT
GTGGCGATACCGATGAAAGCAACTTTCTTCATCACGTATATAATGGTTGATGGTTGGGCAGGAGTT
GCAGGAGAGATTCTAATGCTGAAACCATTGATTATGTTCCATCTCAAAAACGCCTTCTTGGTTAAG
ACTGATAAAGACAGAGAGGAAGCAATGGACCCGGGAAGCATTGGTTTTAACACGGGTGAGCCTCGG
ATACAGCTCTACTTTCTTCTCGGTCTTGTCTACGCTCCTGTGACACCGATGCTTCTTCCTTTTATC
TTGGTCTTCTTCGCCCTTGCTTACATTGTATATCGCCACCAAATCATTAACGTATACAATCAAGAA
TACGAGAGTGCTGCAGCGTTTTGGCCAGACGTTCATGGACGAGTCATAGCAGCATTGGTAATATCA
CAGTTGCTTCTGATGGGTCTATTGGGAACAAAGCACGCTGCATTAGCTGCACCGTTTCTCATTGCT
TTGCCTGTGCTTACCATTGGTTTCCACCACTTCTGCAAAGGTCGTTATGAGCCAGCTTTCATCAGA
TACCCTTTACAGGAAGCTATGATGAAAGATACATTAGAAACCGCAAGAGAACCAAACCTGAACCTT
AAAGGCTACTTGCAAAATGCTTACGTTCATCCGGTTTTCAAAGGCGATGAAGACGATTATGACATT
GATGACAAGCTCGGGAAGTTTGAGGATGAAGCCATTATTGTTCCCACCAAACGTCAGTCGAGGAGA
AATACTCCGGCTCCTAGCATAATCAGTGGGGACGATTCGCCGTCTTTGCCCTTTAGTGGTAAACTA
GTCTAA

SEQ ID NO: 457, protein - Arabidopsis thaliana
MATLQDIGVSAGINILSAFVFFIIFAVLRLQPFNDRVYFSKWYLKGLRSSPARGGAFAQRFVNLDF
RSYMKFLNWMPEALKMPEPELIDHAGLDSVVYLRIYWLGLKIFTPIAVLAWAVLVPVNWTNNTLEM
AKQLRNVTSSDIDKLSVSNIPEYSMRFWTHIVMAYAFTIWTCYVLMKEYETIANMRLQFVASEARR
PDQFTVLVRNVPPDADESVSELVEHFFLVNHPDHYLTHQVVCNANKLADLVKKKKLQNWLDYYQL
KYARNNSQRIMVKLGFLGLWGQKVDAIEHYIAEIDKISKEISKEREEVVNDPKAIMPAAFVSFKTR
WAAAVCAQTQQTRNPTQWLTEWAPEPRDVFWSNLAIPYVSLTVRRLIMHVAFFFLTFFFIVPIAFV
QSLATIEGIVKAAPFLKFIVDDKFMKSVIQGFLPGIALKLFLAFLPSILMIMSKFEGFTSISSLER
RAAFRYYIFNLVNVFLASVIAGAAFEQLNSFLNQSANQIPKTIGVAIPMKATFFITYIMVDGWAGV
AGEILMLKPLIMFHLKNAFLVKTDKDREEAMDPGSIGFNTGEPRIQLYFLLGLVYAPVTPMLLPFI FIGURE 24 (continued)

LVFFALAYIVYRHQIINVYNQEYESAAAFWPDVHGRVIAALVISQLLLMGLLGTKHAALAAPFLIA
LPVLTIGFHHFCKGRYEPAFIRYPLQEAMMKDTLETAREPNLNLKGYLQNAYVHPVFKGDEDDYDI
DDKLGKFEDEAIIVPTKRQSRRNTPAPSIISGDDSPSLPFSGKLV

SEQ ID NO: 458, DNA - Arabidopsis thaliana
ATGAATCGCAATTTTTCACCAGCTGCGATGCCACCGATTTCATCAATGACAATAGATAATTCATTC
TCTCCTCCTCCATCTTCCGGCGACTTACCTGAAATCCCAGATGCTTGGTACGGCAACATTCAGTAT
CTGCTTAATATCTCGGTCATTGGTCTCTTATGCTGCGTCTCCATCTTTCTCTTCGTTAAGCTACGC
AGCGACCACCGTCGTATGCCTGGTCCTTCTGCTCTCTTCTAAGCTCCTCGCCGTTTGGAAAGCC
ACGTGTCGCGAGATCGCTCGTCACTGTGGTGCTGATGCTGCTCAGTTTCTTTTAATTGAAGGTGGA
AGCTTTGTGCTTCTTTTCTCCATTGCTGTTTTAGCTGTTTCGGTTATGCTTCCGTTGAATTTATAT
GCTGGGACTGCTTTGTTGAGTGATGAGCTTTCGAAAACGATGATTACGCATATTCAGAAAGGTTCA
GCTTTGCTTTGGCTGCATTTTGTGTTTGTTGTTATTGTTGTTGTTATCTCGCATTTTGGAATCGCT
GCTATTGAAGCTAGGTTGAAGTTTACTAGGTTTAGAGATGGGAATGGGAATATCAGTGACCCGAAC
GCGAATTCTACTGCTGTGTTTACTATAATGGTGCAGGGTTTGCCTAAGAATTTAGGGTCTGATAGA
GTTGAGTTTGAAGATTGCTTTAGGCTGAAGTACCCTGGGAAAGTTTATAAGTTTATTGTTCCCATG
GATTTGTGTGCTTTGGATGATCTTGCTACAGAGTTGGTTCGTGTTCGAGATGAGATTACTTGGTTA
GTTGCCAAGATGGACTCTAGGCTTCTACCGGATGAGTATGAGAATGTTGGAGATAACGGACTAGTG
TTCTGTGTGTGTTCTTTGTGGGTTAGGGTGAAGGTTTTGTGGTCTCAGATTACAGAGAGGTTTGGA
TTTACAGATGATGAAAAACTGAGGAAGCTGCAAGAACTGAGAGCTGATTTGGAGTCTCAGTTAGCA
GCTTATAAAGAAGGACGAGCACAAGGCGCTGGGGTTGCTTTTGTGATGTTTAAGGATGTGTACACA
GCTAATAAGGCTGTTCAGGATTTTCGAAACGAGAGATCAAGGCGTACTGGAAAGTTCTTCTCTGTC
ACAGAGCTGCGATTACAGAGAAACCAGTGGAAAGTGGACAGAGCACCCTTGGCTACTGATATTTAT
TGGAATCATCTGGGATTGACAAAAGTTGCTCTTATTGTGCGAAGAGTGATTGTTAATACTATTCTA
CTGTTGATTCTTGTGTTTTTCAGCTCCCCATTGGCCTTGATCAGTGCATTGGTAAGTGCCGGGAGA
ATCTTCAATGCTGAAGCATTGGATAGTGCTCAGTATTGGCTCACTTGGGTGCAAACTTCTGGCTGG
ATTGGATCTCTGATTTTTCAGTTCCTGCCCAACGTCTTCATATTTGTTAGTATGTACATTGTAATC
CCTTCTGCGCTCTCGTATCTTTCCAAGTTTGAGCGGCATCTAACAGTGTCTGGGGAACAAAGAGCA
GCTCTCTTGAAGATGGTTTGCTTCTTCCTTGTGAACCTCATCATTCTCAAGGCTCTTGTGGAGTCG
TCACTGGAAAGTGCACTCCTGAAAATGAGCCGTTGCTATTTAGATGGTGAGGATTGCAAGAGGATT
GAAGAATACATGAGCCCTTCCTTCTTATCAAGGTCATGCGTTTCAGCTCTAGCTTTTCTCATCACA
AGCACGTTCCTAGGAATCTCCTTCGATCTACTCGCTCCAATCCCGTGGATCAAGAAGAAAATTCAA
AAGTTCAGGAAGAATGACATGCTTCAGCTTGTCCCCGAGCAAAATGAAGAGTACGCTTTGGAAAAT
CAAGAGCCAAGCAGTAACCTTGAGACACCACTTCTCCCTGAAAACATGTTTGAGTCTCCAAGATTC
GGGGACATAGAACCTATGAGCCAAGACCTCTCTGAATACCCAATCAGCCGAACCTCACCAATCCCT
AAACAGAAATTCGACTTTGCCCAATACTACGCCTTCAATCTCACCATCTTTGCCTTAACAATGATA
TACTCTTCATTCGCTCCACTCGTGGTCCCTGTAGGCGCAGTTTACTTTGGTTACAGATACATTGTC
GACAAATACAACTTCCTTTACGTGTACAGAGTCCGTGGCTTCCCTGCAGGGAATGAAGGAAAGCTA
ATGGACACGGTTTTGTGTATCATGAGATTCTGTGTCGACCTGTACCTCGTCTCAATGCTGCTCTTC
TTCTCAGTTAAAGGAGATTCCACAAAGCTTCAAGCCATATTCACACTTGGAGTGCTTGTGATGTAC
AAGCTTTTGCCTTCGGATACAGACCGGTATCACCCAGCTTTACTAAGAAGTATTCAGACCGTCGAT
AGCATCATCGACGGACCTGTGGATTACGAAGCTTATTCTCACCCAAACTTCGATTGGGACACTTAC
AACAACAGATGA

SEQ ID NO: 459, protein - Arabidopsis thaliana
MNRNFSPAAMPPISSMTIDNSFSPPPSSGDLPEIPDAWYGNIQYLLNISVIGLLCCVSIFLFVKLR
SDHRRMPGPSALFSKLLAVWKATCREIARHCGADAAQFLLIEGGSFVLLFSIAVLAVSVMLPLNLY
AGTALLSDELSKTMITHIQKGSALLWLHFVFVVIVVVISHFGIAAIEARLKFTRFRDGNGNISDPN ANSTAVFTIMVQGLPKNLGSDRVEFEDCFRLKYPGKVYKFIVPMDLCALDDLATELVRVRDEITWL
VAKMDSRLLPDEYENVGDNGLVFCVCSLWVRVKVLWSQITERFGFTDDEKLRKLQELRADLESQLA
AYKEGRAQGAGVAFVMFKDVYTANKAVQDFRNERSRRTGKFFSVTELRLQRNQWKVDRAPLATDIY
WNHLGLTKVALIVRRVIVNTILLLILVFFSSPLALISALVSAGRIFNAEALDSAQYWLTWVQTSGW
IGSLIFQFLPNVFIFVSMYIVIPSALSYLSKFERHLTVSGEQRAALLKMVCFFLVNLIILKALVES
SLESALLKMSRCYLDGEDCKRIEEYMSPSFLSRSCVSALAFLITSTFLGISFDLLAPIPWIKKKIQ
KFRKNDMLQLVPEQNEEYALENQEPSSNLETPLLPENMFESPRFGDIEPMSQDLSEYPISRTSPIP
KQKFDFAQYYAFNLTIFALTMIYSSFAPLVVPVGAVYFGYRYIVDKYNFLYVYRVRGFPAGNEGKL
MDTVLCIMRFCVDLYLVSMLLFFSVKGDSTKLQAIFTLGVLVMYKLLPSDTDRYHPALLRSIQTVD
SIIDGPVDYEAYSHPNFDWDTYNNR

SEQ ID NO: 460, DNA - Aquilegia spp.
TGCCAATCATCAGTCACGTCATTAAGACTAACGCTACTATATAACCATTATAAGCTCCACAATTAT
CTCTTCCATGAAGAAAAAGATGGATTTGAGTTCATTTTTAGCATCATTAACAACATCATTTTTAG
TATTTGTGATTTTAATGTTGGTTTTTACTTGGCTTTCTAGAAAACCTGGAAATAGTGTGATTTATT
ATCCAAATAGAATTGTTAAAGGTTTAAAACCTTATGAAGGTGTTAGAACAAGAAGTCCATTGCTT
GGATTAAAGAAAGTATTACTTCTACTGAAGATGATATTATCTCCATTTCTGGTGTTGATACTGCTG
TTTACTTTGTCTTCTTGTCAACAGTTTTGGGGATATTGGTTTCATCTGGTACACTTTTACTACCGT
CTCTTTTGCCTATTGCTGGAACTGCAAAAGGCGATGCCAAGAACAATAGTAACTTCACCAGCCTTG
AAAGGATTTCCATGGCAAATGTTGAGGAGAAAAGTCCGAGATTGTGGCTTTTCTTTTAGCCACAT
ATGTGGTGTCTTTTTCCACATTGTATATGTTATGGAAAGCCTATATTCATGTTTCTGAGCTAAGAA
GCACAGCTCTAAGTGCTCCGGACGTGAAGCCAGAGCAATATGCGATTCTAGTCAGAGACATACCAG
CTGTTCCGGAGGGACAGACCCGGAAAGAACAGGTTGATTCATATTTCAGCTTACTCCATGGAGATA
CATTTTACAGATCAATGGTGGTGACAGACAACATAGAGGTGAACAAAATTTGGGAAGATTTGGAAA
ACTATAGAAAGAAACGTGCCCGTGCTGAAGCCATACTTGAAGCTTCTAAAACAAGACCTATGAACA
AAACGGGTTTTCTCAGCGGTGACAAAGTTAATACAATAAAACATTGCACAGAAATGATTCATGAAC
TGGTACCCAAATTAAAAATAGAACAGGAAAATACCATTAGAGAAAAACAGCAATCTTCGGCTTTGA
TCTTCTTCACGAACAGGATAGCTGCAACATCTGCTGCCCAGACCATCCATGCGAAGAAGGTTGATA
CATGGACAGTGGTAGAAGCTCCTGAACCACGACAGATAATATGGAGGAATCTTAAAATGAAGTTCT
ATCAAAGGAAGCTCAAAAAGGATATTGTTTTTGTCATAGTTGCGTTGACTATATTCTTTTACATGA
TCCCAATTGCGTTTATCTCTGCTTTTACAACTATGAAGAATCTGAAGAAGCTTCTGCCTTTCATGA
AGCCAATTGTGGACCAGCCACAGGTTAAGACAGTGTTGGAAGCATACTTGCCTCAGATTGCACTCA
TTGTTTTCCTGGCGTTGATTCCAAAGATTCTTATGTTCCTCTCCAAGACTGAGGGCCCTTCAATAA
GCTATGTCGTAAGGGCAAGCTCAGGAAAGTATTTCTACTTCATAATCTTGAATGTCTTTATAGGAG
TTACCATTAGTGGGACATTGTTCAAAACAATCAAGGAAGTCAAACCAAACCAAATTTGGGGGTTGC
TGGGGAAAAGCCTCCCACAAAATGCCACTTTCTTTCTGACGCTGGTTGCATTAAAGTTTTTATTG
GCTATGGACTCGAACTATCCCGTCTAGTTCCTCTTATTATTTTCCATCTGAAGAGGAAGTATTTCT
GTAAAACTGATGATGAAGTGAGAGAAGCTTGGGCTCCTGGGGATATTAACTATGCAACAAGGGTTC
CTAATGACTTGCTCATTGTTACTATAGTTTTATGCTATTCTGTAATAGCTCCAATTATTATTCCCT
TTGGTGTGGCATACTTTGGCGTTGGCTGGCTTGTTCTTCGGAATCAGGCATTGAAAGTTTACGTTC
CATCATATGAGAGCTATGGCCGTATGTGGCCCCATATGCATGCACGTATTCTTGCAGCTCTGATCA
TCTACCAAGTCACCATGATTGGCTACTTCAGTATTAAAAAGTTCCTCTACTCTCCTTTTGCCATCC
CCCTCCCTATTTTCTCAATCGTTTTTGCCTTAATGTGTCGGAGGAAATTTTACAACTCCTTTCTTT
ACACTCCTCTGGAAGTTGTTTGTGCCAAAACAAAGGAAACCCCAAATTTGGAAACTATTTATAACT
CCTACATTCCACCTTGCTTGAGTTCATATAAGTTTGATGAAACTCAAGAGTTTGGTCATGCTTTAT
CTGCATTTCGAGAAACGGGATCATTGGTTTGATTGCAAGTACACTGAATTTCAGCATTCTATGTTA
AGAAGTGTGGTGTGTTTAAATTTTTAGTCGTGTGGTTTACAACTTATCTATAGCTCTGCTCTTCTA
GTTAGTACAGTCTGAGAGTAATTTTATGCTGTTGTGACTTTCTGGTTCACTCG

SEQ ID NO: 461, protein - Aquilegia spp.
MDLSSFLASLTTSFLVFVILMLVFTWLSRKPGNSVIYYPNRIVKGLKPYEGVRTRSPFAWIKESIT
STEDDIISISGVDTAVYFVFLSTVLGILVSSGTLLLPSLLPIAGTAKGDAKNNSNFTSLERISMAN
VEEKSPRLWAFLLATYVVSFSTLYMLWKAYIHVSELRSTALSAPDVKPEQYAILVRDIPAVPEGQT
RKEQVDSYFSLLHGDTFYRSMVVTDNIEVNKIWEDLENYRKKRARAEAILEASKTRPMNKTGFLSG
DKVNTIKHCTEMIHELVPKLKIEQENTIREKQQSSALIFFTNRIAATSAAQTIHAKKVDTWTVVEA
PEPRQIIWRNLKMKFYQRKLKKDIVFVIVALTIFFYMIPIAFISAFTTMKNLKKLLPFMKPIVDQP
QVKTVLEAYLPQIALIVFLALIPKILMFLSKTEGPSISYVVRASSGKYFYFIILNVFIGVTISGTL
FKTIKEVKPNQIWGLLGKSLPQNATFFLTLVALKFFIGYGLELSRLVPLIIFHLKRKYFCKTDDEV
REAWAPGDINYATRVPNDLLIVTIVLCYSVIAPIIIPFGVAYFGVGWLVLRNQALKVYVPSYESYG
RMWPHMHARILAALIIYQVTMIGYFSIKKFLYSPFAIPLPIFSIVFALMCRRKFYNSFLYTPLEVV
CAKTKETPNLETIYNSYIPPCLSSYKFDETQEFGHALSAFRETGSLV

SEQ ID NO: 462, DNA - Medicago truncatula
ATGATTCTTTCTGCTCTTTTAACTTCTGTTGCAATTAATCTTGGTCTCTGTCTTCTATTTTTCACA
CTATACTCTATATTGAGAAAACAGCCTGGTAATATAAATGTATATGTACCACGCTTCGTTGCTGAA
GGAAAGGTTAAAGAAGGTGGTCAATTTAACTTGGAACGCCTGTTACCTACTGCTGGTTGGGTGAGA
AAGGCATGGGAGCCAACAGAAGACGAATTTTATCGACTTCAGGCTTAGATGCCTTTGTTTTCATG
CGCATGTTTGTCTTTAGCTTGAAAGTATTTACTTTTGGTGCAATTATCGGAATCGTTCTTATTCCA
ATTAATTATATGGGGAGTCAGCTCACTGACGACTCCGATTTTCAACACAAGTCTTTGGACTCGTTC
AGTATTTCTAATGTTAACAACGGTTCAAACAGGTTATGGATCCATTTTCTGCTGCATATGTTTTC
ACTGGAGTTGTTTGCTATCTTCTTTATTATGAGTATCGATACATTTCGTCCAAACGAATAGCTTGC
TTTTATTCTTCTGAGCCACAACCTCATCACTTTACCGTGTTGGTCCGTGGTATTCCTATTCCACCT
GGAAGCACATGTACCGATGCTGTCCAGCGTTTTTCTCTGAGTATCACCCTTCCACGTATCTTTCA
CATTCAGTCGTTCGTCGAAGCAGCAAACTTCACAATCTTATTACTGATGCAGATAAATTGTACAA
AAGCTTACCAATCTTAAACAAAAAATGATGCTCCTAAAAGGCAGACGCGTGAAGGTTGTTGTGGA
CTCTTTGGGCCTAAAGTTGATACTGTAGATCACTATGAAAGGAGACTTGGGAATATAGAAGATAAT
GTGAGAATGGAACAGTCCTCATTGGCATCAAAGGAAGTTCCTGCTGCATTCGTTTCATTTAAAACT
CGATTTGGTGCTGCAATAGCTTTACACATTCAAGAAGGTGTCAATCCAACAGAATGGATTACCGAG
GAAGCTCCCGAACCTCATGATGTTTATTGGCCTTTCTTTACCGTTTCATTCCTTAAAAGATGGATC
AGCAAGCTGGTAGTTTATGTTGCATATACTACTCTCACAGTTCTGTTTTTAATCCCGGTTGCAATA
GTACAAGGTCTTACTCATCTTGAACAGTTGGAAACGTTCTTCCCGTTTTTGAAAGGCGTACTGAGA
CTGTCAGTTGTGAGCCAAGTTATAACAGGATACCTTCCAAGTTTGATTCTTCAGTTGTTTCTATCA
TATGTTCCACCTACTATGATTATGCTTTCATCTTTGCAAGGATACATTTCATGGAGTCAGATACAA
AAAAGTGCATGCACTAAAGTGTTACTGTTTACCATATGGAACATTTCTTTGCAAATGTACTATCA
GGGTCTGCTCTTTATCGAGTGAACATCTTTCTTGAGCCGAAAAACATCCCAAGAGTATTAGCCGAA
GCTGTACCCTCACAGGCATCGTTCTTCATTGCATATGTTGTGACATCTGGATGGACCACAATAGCA
TCAGAGCTCTTTCGATTATCTACACTTATTTCCAATTTTTTAAGTAGAACTTTTTGTAAAAACGGC
GATGATGATTTTGAGCCCCGTCAATTCCTTACCACAGCGAAATTCCCAGGATTCGTCTCTTCGGT
CTTCTTGGTGTGACATACTTCTTTCTTGCTCCACTCATACTTCCATTTCTCTTGATTTACTTTTGT
TTGGGATACATCATTTTCCGCAACCAGTTTTGAAAGTTTATGTGCCAAAGTTTGAGACTGGAGGA
GAGTTTTGGCCTACAGTGCATAACTCCACGATATTTTCATTGATACTAATGCATGTAATAGCCATT
GGGATTTTTGGTTTGAAGAAACTTCCTCTAGCATCAGCATTGACTCTTCCTCTTCCAATTCTCACA
CTTCTTTTCAACGAGTATTGCCAGAAACGGTTCCGACCTATATTCAAGAATTTTCCAGCTGAGTGT
TTGATTAAGAAGGACAGAGCAGACGAAATCGAGCATAATATGTCTGAATTTATGATAAAATGGAA
AATGCATATAATGATCCAGCTCTAATGCCAGTCCAATATTCAGAAAGGTTTGATAGTCAAAGATCA
CCACTTCTTCATAGTTCTCAATTTTAATTCATATTATGAGGCTGGTTGCTACTATGAAAATCAGCA
TACCCTCAGTTTGATTTCCCGATTTCCTGTAAAATTTATTTGATTGTTCGTGGCAATGTGTTGTAA
ATTGTTTGGCCGAGAATTTATGCTTTAATGAGTATGGAATGGAAGCTTAGC

FIGURE 24 (continued)

SEQ ID NO: 463, protein - Medicago truncatula
MILSALLTSVAINLGLCLLFFTLYSILRKQPGNINVYVPRFVAEGKVKEGGQFNLERLLPTAGWVR
KAWEPTEDEFLSTSGLDAFVFMRMFVFSLKVFTFGAIIGIVLIPINYMGSQLTDDSDFQHKSLDSF
SISNVNNGSNRLWIHFSAAYVFTGVVCYLLYYEYRYISSKRIACFYSSEPQPHHFTVLVRGIPIPP
GSTCTDAVQRFFSEYHPSTYLSHSVVRRSSKLHNLITDADKLYKKLTNLKQKNDAPKRQTREGCCG
LFGPKVDTVDHYERRLGNIEDNVRMEQSSLASKEVPAAFVSFKTRFGAAIALHIQEGVNPTEWITE
EAPEPHDVYWPFFTVSFLKRWISKLVVVYVAYTTLTVLFLIPVAIVQGLTHLEQLETFFPFLKGVLR
LSVVSQVITGYLPSLILQLFLSYVPPTMIMLSSLQGYISWSQIQKSACTKVLLFTIWNIFFANVLS
GSALYRVNIFLEPKNIPRVLAEAVPSQASFFIAYVVTSGWTTIASELFRLSTLISNFLSRTFCKNG
DDDFEPPSIPYHSEIPRIRLFGLLGVTYFFLAPLILPFLLIYFCLGYIIFRNQFLKVYVPKFETGG
EFWPTVHNSTIFSLILMHVIAIGIFGLKKLPLASALTLPLPILTLLFNEYCQKRFRPIFKNFPAEC
LIKKDRADEIEHNMSEFYDKMENAYNDPALMPVQYSERFDSQRSPLLHSSQF

SEQ ID NO: 464, DNA - Medicago truncatula
ATGATTTTTTCTGCTCTTCTAACTTCAATTGCAATTAATTTTGGCTTTTGTTCTCTATTTTTCACC
CTGTACTCTATATTGAGGAAGCAACCTGGTAATATTCTTGTCTATGCACCACGCTTAGTTTCCGAA
GGAAAACTCCAAGAGGGCAATCAAGATAACTTGGAACATTTGTTACCTACTTCTGGTTGGGTGAGA
AGAGCATGGGAGCCTTCTGATGATGAATTTATATCAACTGCAGGCTTAGATGCTTTCGTCTTCATC
CGTATATTTGTCTTTAGTTTAAAAGTATTTGCCTTTGCTGGAATTGTTGGGACAATCTTTCTTCTT
CCAGTTAATTACATGGGGACTCAGATTTGTGATGATTCCGAGTCTCAGAAACGTCATTGGATTCC
TTTAGTATTTCAAACGTTAACAATGGTTCGCACAGGTTATGGATTCATTTCAGCGCCGTTTATATT
TCACTGGGGTTGTTTGCATTCTTCTATATTATGAGTATGAGTACATTGCATCAAAAGAATTGCT
TGCTTCTATTCCTCGAAGCCGGAGCCTCGTCAGTTTAGTATATTAGTACGAGGTATTCCGGTTCCT
CCTGGATGTACATGTAGTGAAGCTGTCGAACAATTCTTTATGGAGTATCACCCTTCTGCTTATCAT
TCACATTCAGTTGTTCGTCGAAGCAGCAAACTTCAAATTCTAGTTACTGATACAGATAGACTGTAC
AAAAGGCTTACCCAATTGAAAGATAAAGAAAACTCTCCTCAAAGGCATAGGCGTGATGGATTTTTA
GGACTTTTTGGGCAAAAAGTTGATCTGTTAGATCATTACGAAAAGAAATTGGGAGACATTGCAGAT
AATGTGAGAATAGAACAGTCTGCATTGGCAGGAAAGGAAGTTCCAGCAGCATTTGTCTCATTTAAG
TCACGATTCGGTGCTGCAATAGCTTTGAACTCGCAACCAGGTGTCAATCCCACACACTGGATCACC
GAACCAGCGCCAGAGCCTCATGATGTTTATTGGCCTTTCTTTTCTGTCACATTCATTCGAAGATGG
ATCAGCAGGCTGGCAGTTTTTGTTGCTTGCATTGCTCTTACAATTCTATTTTAATCCCAGTTGCA
GTAGTTCAAGGCCTTACCCATCTCGATCAATTAGAAACCATGTTCCCACCTCTGAGAAGCATACTG
AGACTGACACTTGTGAGTCAAGTTATAACAGGATACCTTCCCATTCAGATTCTACAGTTGTTTCTG
TCTTTTGTGCCAGCTATTATGATTTTTCTTTCATCCTTGCAAGGATATATTTCATGGAGTCAGATA
CAAAAAAGTGCATGCACTAAAGTATTATGGTTTACCATCTGGAACATTTTCTTTGCAAACGTATTA
TCAGGGTCGGCTCTCTACCGATTGAACTACTTTCTTGAGCCCAAAGAGTTTCCTAGAGTACTAGCT
GAAGCTGTACCAGCTCAGGCATCATTCTTCATGGCGTATATTGTGGCATTCGGATGGACTAATATA
GCATCAGAACTTTTTCAATTGATTCCACTTTCTTACAATTATGTAAATAGATATTTTGGTGGAAAC
TTTAGTGATGATTTGAAGCACCATCAATTCCTTACTACAGCGAAATTCCCAGGATTCTTTTCTTT
GGTCTTCTTGGTGTTACATACTTTATCCTTGCTCCTCTCATACTGCCATTTATCTTGGTCTACTTT
TGTTTGGATACATCATTTACCGCAACCAGCTATTATATGTTTATGTGCAAAAATTCGAGACTGGA
GGAGAATTTTGGCCTATAGTACACAACTGCACAATTTTTTCAATGGTGCTAATGCACATCATAGTA
ATTGGGATATTTGGGTTGAAGGAGCTTCCAATAGCATCCGGATTCACTCTTCCTCTTCCTATTGTC
ACACTTCTTTTCAATGAATACTGCCAGAAGCGGTTCATTCCTATATTCAACGCTTATCCTGCCGAA
TGTTTGATCAAGAAAGATAGAGCAGATCAAAATGATCCGAACATGTCCGAGTTTTATGATAAGTTA
ACCAATGCATACAATGATCCAGCTCTAATGCCAATCAAGTATCCCGGACGGTTTAGTAGTCACAGA
TCTCCCCTACTTGGTAGCTCAGAATCAAACACTAATGTTCTTGTTGCTACTGAAGGCCTGTTTGTG
CTTGATAGGGATGGTAATGGGGCGGGATGGGATGGGTTTTACCTTCCCCGTTCCCATACCCAACTC

FIGURE 24 (continued)

```
TCATGTACTTACCTGTTATTCTACCCATATTCAGCGGGGATAAGAAATCGATTCTCATCCCCATCT
CCGACGGGTTTGGGTATCCCCGCCTCATCCCCATCCCCGAATCGGATAACTTTTCTTAAATAAAAA
TAGAAGCATTTGTCAGCCCCGAGCGTAATGTTGTAATACATTATCCAGCAAAGAGATGATGGTGAT
CAATTGATATGGTGATGG
```

SEQ ID NO: 465, protein - Medicago truncatula
```
MIFSALLTSIAINFGFCSLFFTLYSILRKQPGNILVYAPRLVSEGKLQEGNQDNLEHLLPTSGWVR
RAWEPSDDEFISTAGLDAFVFIRIFVFSLKVFAFAGIVGTIFLLPVNYMGTQICDDSESQKTSLDS
FSISNVNNGSHRLWIHFSAVYIFTGVVCILLYYEYEYIASKRIACFYSSKPEPRQFSILVRGIPVP
PGCTCSEAVEQFFMEYHPSAYHSHSVVRRSSKLQILVTDTDRLYKRLTQLKDKENSPQRHRRDGFL
GLFGQKVDLLDHYEKKLGDIADNVRIEQSALAGKEVPAAFVSFKSRFGAAIALNSQPGVNPTHWIT
EPAPEPHDVYWPFFSVTFIRRWISRLAVFVACIALTILFLIPVAVVQGLTHLDQLETMFPPLRSIL
RLTLVSQVITGYLPIQILQLFLSFVPAIMIFLSSLQGYISWSQIQKSACTKVLWFTIWNIFFANVL
SGSALYRLNYFLEPKEFPRVLAEAVPAQASFFMAYIVAFGWTNIASELFQLIPLSYNYVNRYFGGN
FSDDFEAPSIPYYSEIPRILFFGLLGVTYFILAPLILPFILVYFCLGYIIYRNQLLYVYVQKFETG
GEFWPIVHNCTIFSMVLMHIIVIGIFGLKELPIASGFTLPLPIVTLLFNEYCQKRFIPIFNAYPAE
CLIKKDRADQNDPNMSEFYDKLTNAYNDPALMPIKYPGRFSSHRSPLLGSSESNTNVLVATEGLFV
LDRDGNGAGWDGFYLPRSHTQLSCTYLLFYPYSAGIRNRFSSPSPTGLGIPASSPSPNRITFLK
```

SEQ ID NO: 466, DNA - Medicago truncatula
```
ATGGCTTCACTTGGCGATATAGGACTTGCAGCTGCAATAAACATCCTTACTGCAATTGTATTCTTA
CTGGCATTTGCCATACTTCGGATTCAACCTATAAACGATAGGGTGTATTTTCCAAAATGGTATATG
AAGGGTTTAAGGTCCAGTCCATTGCAAGGAGGGGCATTTGTGAGCAAATTTGTCAATATAGACTTC
AGGTCATACATAAGGTTCTTGAACTGGATGCCTGCTGCATTGCAAATGCCGGAACCCGAACTAATT
GAACATGCAGGCTTGGATTCTGCTGTATACTTGAGGATCTACTTACTCGGGCTGAAAATATTTGTC
CCAATTTCACTCCTAGCATTTTCTGTTATGGTCCCTGTCAATTGGACCAATGACACCTTGAAACGT
TCAAATGTGGTTTATACCAGCATCGATAAGCTTTCAATTTCAAATATTCCACTTGGATCAAATAGA
TTTTGGACTCACTTGGTAATGGCTTATGCTTTTACCTTCTGGACATGTTATATCTTGAAAAGGGAG
TATCAGATAGTTGCAGCAATGAGATTGTCTTTTCTTGCATCTGAAAGACGCCGTCCTGACCAATTC
ACGGTGCTTGTTAGGAATGTACCGCCTGATGCTGATGAATCAGTCAGTGAACTAGTTGAACATTTC
TTTTTGGTCAACCATCCTGATCAATATCTAACTCATCAGGTTGTTTACGATGCAAAGAAACTCTCT
AGTCTAGTTGCTAAGAAGAAGAAACAACAGAATTGGCTTGACTACTATGAACTTAAATATTCTAGA
AATGAATCCGTAAGGCCAACTAAAAAGACTGGCTTTTTAGGTCTTTGTGGCAGTAAAGTGGATGCT
ATTGATTTTTATACTGCTGCAATTGAGAGACTATCAAGAGACATAGAGCTGGAGAAAGATAAGGTG
ACAAAGAATCCTAAATCTATAATGCCAGCAGCCTTTGTTTCCTTCAAAACTCGTTGGGGTGCTGCA
GTTTGTGCACAAACTCAACAAACTAGAAATCCAACAATATGGTTGACTGAATGGGCTCCAGAGCCC
CGTGACATATACTGGGATAACATGGCTATACCATATGTTTCTCTCAATAAGGAGACTTGTAATT
GGTGTTGCTTTCTTCTTTCTTACATTCTTTTTCATGATTCCCATTGCATTCGTACAGTCACTTGCT
AATATAGAGGGCATTGAAAAAGCCGCACCATTCCTCAAGTCCATTATTGAAATCGACGTCATCAAG
TCTTTTATACAAGGTTTCCTTCCTGGGATTGCTTTGAAGTTATTCCTCATTTTTTGCCAACAATA
TTGATGATTATGTCCAAGTTCGAAGGGTTTATAAGCCAGTCTTCTCTGGAAAGAAGATGCGCCTCA
AGATATTACATCTTCCAGTTCATTAATGTGTTTCTGGGGAGCATAATTACCGGGACTGCATTCCAA
CAACTAGATAAATTCATTCATCAGTCTGCAAATGAAATTCCAAAGACAATTGGTGTTTCGATTCCA
ATGAAAGCAACTTTCTTCATAACATACATAATGGTTGATGGATGGGCAGGATGTGCTGGTGAGATT
TTAAGGTTGAAGCCTTTGATATTTATCACTTAAAGAATTTCTTGTTGGTGAAGACTGAAAAAGAC
CGTGAAGAAGCAATGGATCCAGGGACTATTGGTTTCAATACAGGAGAACCTCAAATACAACTTTAT
TTCTTGCTTGGCCTTGTGTATTCTGTAGTCACACCATTTCTACTTCCATACATCATTGTCTTTTTT
GGTTTGGCATATCTTGTCTACCGTCATCAGATTATAAATGTGTACAACCAAGAATATGAGAGTGCT
```

GGAGCATTCTGGCCTGATGTCCATGGACGTATTGTATTTGCATTAGTTGTCTCACAACTTCTGTTA
ATGGGATTATTGAGTACAAAAGAAGCTGCTAACTCGACTCCATTACTCATCGCACTCCCAGTTTTG
ACAATATGGTTTCATCGGTTTTGCAAGGGAAGCTACGAACCTGCTTTTACTACTCATCCATTACAG
GAAGCAATGGTCAAAGACACATTGGAGCGTACTAAAGAGCCAAACTTCAATTTGAAAGATTTCCTC
CATGATGCATATATCCATCCCGTTTTCAATGATGACGGAGACACAGACAGTGATGTGATGAGTCAA
GAATGGAAGGAAGAGCCAGTAATTGTCCAAACAAAACGCCAGTCGCGGAAGAACACACCTGCGCCT
AGCAAACATAGTGGTGGCTCATTACAAACCTCTATGCATGGTACTACTGATGTCTGATGATGAGCA
TTAACAGCCTTAGATTTGAGTTGAAGTCAAAGACTAAGTTAGTGTTGGAGCTTAATTGGTTCAGCA
TAAATCTATAGACAGATTGAAGGTCCTACAAGAAGCATAGATGGTTTGGTTCACAAGTTACTCT
TGTAAACATTGCACAGTGATTTCCAGATTTTCTTTTGTATATAGATATGCAAAGCAAGAATTTTGG
GATGAGACAGATAAGAGCAATATTCAGGTCAAATTGTAACGAGTTTTTGCTCTATGGATCTTCTGT
ATCAAATATACTAGTGTCTTGTTTTATTTTTAAAAATTG

SEQ ID NO: 467, protein - Medicago truncatula
MASLGDIGLAAAINILTAIVFLLAFAILRIQPINDRVYFPKWYMKGLRSSPLQGGAFVSKFVNIDF
RSYIRFLNWMPAALQMPEPELIEHAGLDSAVYLRIYLLGLKIFVPISLLAFSVMVPVNWTNDTLKR
SNVVYTSIDKLSISNIPLGSNRFWTHLVMAYAFTFWTCYILKREYQIVAAMRLSFLASERRRPDQF
TVLVRNVPPDADESVSELVEHFFLVNHPDQYLTHQVVYDAKKLSSLVAKKKKQQNWLDYYELKYSR
NESVRPTKKTGFLGLCGSKVDAIDFYTAAIERLSRDIELEKDKVTKNPKSIMPAAFVSFKTRWGAA
VCAQTQQTRNPTIWLTEWAPEPRDIYWDNMAIPYVSLSIRRLVIGVAFFFLTFFFMIPIAFVQSLA
NIEGIEKAAPFLKSIIEIDVIKSFIQGFLPGIALKLFLIFLPTILMIMSKFEGFISQSSLERRCAS
RYYIFQFINVFLGSIITGTAFQQLDKFIHQSANEIPKTIGVSIPMKATFFITYIMVDGWAGCAGEI
LRLKPLIFYHLKNFLLVKTEKDREEAMDPGTIGFNTGEPQIQLYFLLGLVYSVVTPFLLPYIIVFF
GLAYLVYRHQIINVYNQEYESAGAFWPDVHGRIVFALVVSQLLLMGLLSTKEAANSTPLLIALPVL
TIWFHRFCKGSYEPAFTTHPLQEAMVKDTLERTKEPNFNLKDFLHDAYIHPVFNDDGDTDSDVMSQ
EWKEEPVIVQTKRQSRKNTPAPSKHSGGSLQTSMHGTTDV

SEQ ID NO: 468, DNA - Medicago truncatula
ATGACCAAGAAATGTAAGAATAAGTTGTCCCTATTGGATTTTTCACAACAAAAGACTTCAAAAGTA
GATTTGCTTGAGGAAAAGCTTCAAGTCCTTTGTCACAAGATTCACCAGTTACAATGCAAAGACATG
CTCAAGGAAAAGGAGTTACCTGTCGCTTTTGTTACATTCAAGTCGCGTTCTGCTGCTGTAGTAGCA
GCTCAGTTGCAGCAGCATTCACATCCACTTCTTTGGGTCACTGAACTTGCTCCAGAACCAAGGGAT
GTTTCCTGGAGGAATTTGAGATTATCCTACAGAGTCCTTCCGCTTTGTAGACTAGGCGTTGTCATT
GCGGCATCATTGCTTACAATTTTCTTTGCCATACCTGTTACTGCAGTTCAAGGAATAGCCAAATAT
GAAAAACTGAAAAAATGGTTTCCTCCAGCTATGGCTGTGCAGTTGATACCAGGATTAAGCTCTATT
GTGACAGGATATCTTCCAAGTGTCGTGCTCAAAGGATTTATATATGTTGTGCCATTTGCAATGTTT
GCTATGGCAAAAGTAGCTGGATGTGTTGCAAGAAGTAAGGAGGAAATCAAAGCCTGCAACATGGTT
TTCTATTTTCTAGTTGGAAACGTGTTCTTCGTGAGTGTCTTATCGGGATCTCTCCTTGATACACTC
GGAAAATTTATTAGCCGTCCTAAAAGTATTCCAAATGAACTTGCCACGGCTGTCTCTGCCCAAGCA
GATTTCTTTGTGACATACATCTTGACAGATGGACTATCTGGTTTTCTTTGGAAATTCTCCAACCT
GGCTTACTTATTTGGAATATTTTAACGTCTTGTACTCCTGGCCGTCAAAGAGAGAGGAATCCTTAT
CTTTATTCATTGCCTTACTTTAGAATCATCCCTTTTGTCTCTCTCTAATACTAATTGGTTTAGTG
TATGCAGTAGTTGCCCCGTTGTTGCTCCCATTTCTCATTGTTTACTTCTGTCTAGGCTATGTTGTC
TATATCAACCAGATTGAAGATATGTATGAAACTACATACGAAACATGTGGACAATATTGGCCATAC
ATTCATCACTACATTCTCCTTGCAATCATTCTCATGCAGATTACCATGATCGGTCTATTTGGACTC
AAGTTAAAGCCAGCTGCTTCCATATCAACCATACCACTACTGTTGTTCACATTGATGTTTAATGAG
TATTGCAAGTTGCGTTTTCTCCCTTCCTTTCACCATCAGTCTCTCAAGGATGCGGCTGAAAATGAT
GAACTTGATGAAAGTGTGGTCAGTTGGAGTTCCATTATAAGAATGCAGGCAATGCCTATTATCCA
TCAGGTCTGCAACCAGTGAGTTTCGCGGTATCAGAGTCCAGCTCAACACCATTAGTATCTTCATGA

SEQ ID NO: 469, protein - Medicago truncatula
MTKKCKNKLSLLDFSQQKTSKVDLLEEKLQVLCHKIHQLQCKDMLKEKELPVAFVTFKSRSAAVVA
AQLQQHSHPLLWVTELAPEPRDVSWRNLRLSYRVLPLCRLGVVIAASLLTIFFAIPVTAVQGIAKY
EKLKKWFPPAMAVQLIPGLSSIVTGYLPSVVLKGFIYVVPFAMFAMAKVAGCVARSKEEIKACNMV
FYFLVGNVFFVSVLSGSLLDTLGKFISRPKSIPNELATAVSAQADFFVTYILTDGLSGFSLEILQP
GLLIWNILTSCTPGRQRERNPYLYSLPYFRIIPFVSLSILIGLVYAVVAPLLLPFLIVYFCLGYVV
YINQIEDMYETTYETCGQYWPYIHHYILLAIILMQITMIGLFGLKLKPAASISTIPLLLFTLMFNE
YCKLRFLPSFHHQSLKDAAENDELDEKCGQLEFHYKNAGNAYYPSGLQPVSFAVSESSSTPLVSS

SEQ ID NO: 470, DNA - Populus trichocarpa
TTTGCTAACAGCCAATTTCATCTTTGCTTAATGTTGAATGTACCTCCTGATCCAGATGAAACTGTC
AGTGAGCTCTTGGAGCACTTTTTTCTAGTGAATCACCCAGATCATTACCTCACTCATCAGGTGGTG
TGCAATGCCAACAAACTAGCCAGCTTGGTCAAGAAGAAGAAAAAAAGCAGAACTGGCTTGACTAC
TACCAACTCAAGTACTCCAGGAATCAATCGCAGAGGCCTCAGATGAAGACTGGTTTCCTTGGGCAT
TTTGGGGGAAAAGTGGATGCAATCGATCATCACATATCAGAGATTGAGGAACTGTCAAAAGAAATA
GAAGAAGAGAGGACAAGGGTTTTAAAGGATCCAAAGTCTATCATGCCAGCAGCATTTGTTTCATTC
AAGACTCGATGGGGTGCAGCTGTGTGTGCACAAACCCAACAATCAAGAAATCCGACTTTGTGGTTA
ACAGAGTGGGCTCCGGAGCCACGCGATGTATATTGGCAAAACTTAGCCATTCCGTACATGTCACTC
AAAGTTAGGAGGCTGATAATTGGAGTTGCATTCCTTTTACTTACCTTCTTTTTCATAATACCTATT
GCATCTGTACAAGCTCTAGCAAGTATCGAGGGAATAGAGAAAAGAGCCCCTTTTCTGAAGTCTGTT
ATTGAAATAAAATTTATCAAATCTGTTATCCAAGGTTTTCTTCCTGGCATTGTGTTGAAGCTCTTC
CTTATCTTCCTGCCAACAATATTGATGATCATGTCTAAATTTGAAGGCTTCATATCTCTATCATCT
TTGGAAAGGAGATCAGCAACGAGAAATTATATTTTCCTCATTATCAATGTATTCCTTGGGAGCATA
CTCACTGGAGCTGCATTTGAACAGCTAAATTCTTTTATTAAGCAGTCTGCTAACGAGTATGTTACT
CTCACAAATTGATTAAATATTCATGTCTTCATTATTTAATTGCTCCATTAGGGCGTATGCATAATT
AAGTGTGAAGGTGTGTTCATGGCATG

SEQ ID NO: 471, protein - Populus trichocarpa
MLNVPPDPDETVSELLEHFFLVNHPDHYLTHQVVCNANKLASLVKKKKKKQNWLDYYQLKYSRNQS
QRPQMKTGFLGHFGGKVDAIDHHISEIEELSKEIEEERTRVLKDPKSIMPAAFVSFKTRWGAAVCA
QTQQSRNPTLWLTEWAPEPRDVYWQNLAIPYMSLKVRRLIIGVAFLLLTFFFIIPIASVQALASIE
GIEKRAPFLKSVIEIKFIKSVIQGFLPGIVLKLFLIFLPTILMIMSKFEGFISLSSLERRSATRNY
IFLIINVFLGSILTGAAFEQLNSFIKQSANEYVTLTN

SEQ ID NO: 472, DNA - Populus trichocarpa
CATATTCATGATTTCTTCCCTTTTCCTGATATGAAGCTCATAGGAATTCCTAAAACAATTGGTGTA
GCTGTTCCAATGAAAGCAACTTTCTTCATAACCTATATAATGGTTGATGGATGGGCTGGGATTGCT
GGGGAAGTTTTAATGTTGAAACCACTGATATTCTACCACTTGAAAAATTTCCTTTTGGTGAAGACT
GAAAAAGACAGGGAAGAGGCAATGGATCCTGGAAGTCTTGGTTTTCACACCGGCGAACCCCGTATA
CAATTATATTTTCTGCTAGGGCTTGTATATGCAACAGTGACACCAGTTCTCCTTCCATTCATAGTT
ATTTTCTTCGCCTTCGCCTATTTAGTGTTCCGTCATCAGATCATAAATGTTTACAACCACGAGTAT
GAAAGTGGTGCAGCATTCTGGCCTGATGTCCATGGGCGTATTATTACTGGGCTAGTAATCTCACAG
CTGGCTCTGATGGGATTACTGAGTACAAAAGAAGCTGCACAGTCAACACCATTTCTCATTGCTCTC
CCTGTCCTCACTATATGGTTTCATAGGTTCTGCAATGGACGCCACAAATCTGCATTTGTCAAATAT
CCATTACAGGAAGCAATGATGAAAGATACCCTGGAACGAGCAAGGGATCCAAACTTTAATCTGAAA
GCTTGCCTTCATAGTGCATATGTTCATCCAATTTTCAAAGGTGACGATGATGATGAAGACGACCTG
AGCGTAGAGATGGAAACTGAGAGTGTCTTAGTGCCTACAAAACGCCAATCGCAAAGAAATACACCA
GTACCTAGCAAAATCAGCGGGGGATACTCACCATCTTTGCCGGAGGCAGTTAAAAATGGAGAGCTC
TGAAATGGAGATCGTTAAATATGACACGTGCATGAATACACCTCGCTGTACATTTGACACCATCCA
TTGCCAGGAGACAGTAA FIGURE 24 (continued)

SEQ ID NO: 473, protein - Populus trichocarpa
MKLIGIPKTIGVAVPMKATFFITYIMVDGWAGIAGEVLMLKPLIFYHLKNFLLVKTEKDREEAMDP
GSLGFHTGEPRIQLYFLLGLVYATVTPVLLPFIVIFFAFAYLVFRHQIINVYNHEYESGAAFWPDV
HGRIITGLVISQLALMGLLSTKEAAQSTPFLIALPVLTIWFHRFCNGRHKSAFVKYPLQEAMMKDT
LERARDPNFNLKACLHSAYVHPIFKGDDDDEDDLSVEMETESVLVPTKRQSQRNTPVPSKISGGYS
PSLPEAVKNGEL

SEQ ID NO: 474, DNA - Populus trichocarpa
TTTTCTTAGGTTTCTTTGTTGAAGGTATAAATGGCAACGCTCGAAGATATAGGGGTTTCAGCAGCT
ATAAATCTACTAAGTGCATTAATTTTCCTATTTCTATTTGCAATTTTGAGGCTGCAACCTTTCAAT
GATAGGGTTTACTTTCCGAAATGGTATCTCAAGGGCTTAAGAAACAGTCCCTCGCGGTCAAGGGCA
TTGGTTAGTAGGTTTGTGAATTTAGACTGTAGATCATACATTCAGTTCTTAAATTGGATGCCTCAA
GCACTGAAAATGCCAGAGCCTGAACTTATTGATCACGCAGGATTGGATTCTGCGGTTTACTTGCGC
ATTTACTTGATGGGACTTAAGATTTTTGTCCCTATAACTATCCTTGCTTGGGTTGTCCTGGTACCA
GTTAATTACACTAATAATGCTTTAGAGGCAGAGAAGATGGCGGCCAATGTGACTGCTAGTGACATC
GACAAACTTTCGATTTCAAATGTTCCACTTAAATCACAAAGATTCTGGGCTCATATAGTGATGGCT
TATGCCTTTACTTTCTGGACTTGCTATGTACTACTGAAGGAGTACGAGAAAGTTGCATCAATGAGG
TTGCAATTTCTTTCCTCAGAAAGACGTCGTCCAGATCAATTCACAGTCCTAGTTAGGAATGTACCT
CCAGATCCAGATGAATCTGTTAGTGAGCTTGTGGAGCACTTTTTCTGGTGAATCATCCAGATCAT
TATCTCACTCAACAGGTGGTGTGCAATGCTAACAATCTAGCCAGCTTGGTGAAGAAGAATGAAGGC
ATGCAGAACTGGCTTGACTACTACCGCTTCAAGTATTCTAGAAATCGATCACAGAGGCCTCAGACG
AAGACTGGCTTTCTTGGTCTCTGGGGGCAAAAGTAGATGCAATTGATTATTACATATCAGAGATT
GAGAAACTGTCGAAAGAAATAACAGAAGAAAGGGAAAAGGTTTTAAATGATCCGAATTGTATCATG
CCTGCTGCATTCGTTTCGTTCAAGACTCGATGGGGTGCAGCAGTTTGTGCACAAACTCAACAATCA
AGAAATCCAACTTTGTGGTTAACAGAGTGGGCTCCCGAGCCGCGCGATGTATATTGGCCAAACCTA
GCCATTCCATATGTGTCGCTCTCAGTTAGAAGGCTGATAATTGGAGTTTCGTTCTTTTTTCTTGCC
TTCTTTTTCATGATCCCTATTGCATTTGTTCAATCTCTAGCAAGTATTGAGGGAATTGAGAAAAGC
CTTCCCTTTTTGAAGCCTGTTATTGAAGTAGAATTTATCAAATCAGTTGTCCAAGGATTTCTACCT
GGGATTGCGCTAAAGCTCTTTCTTATCTTACTGCCGACGCTATTGATGATGATGTCTAAATTTGAA
GGCTTGACATCTCTATCATCTTTGGAAAGGAGATCAGCAATGAGATATTACATTTTCATCATTATC
AATGTGTTCCTCGGAAGCATACTCACCGGGGCTGCATTCGAACAGCTAGATTCTTTTATCAAGCAG
TCTGCCAGCGAAATTCCTAAAACAATTGGTGTAGCTATTCCGATGAAGGCAACTTTCTTCATAACC
TATATAATGGTTGATGGATGGGCTGGAATAGCTGGAGAAGTTCTAATGTTGAAACCATTGATAATT
TACCACTTGAAGAATTTCTTTTGGTGAAGACTGAAAAAGATAGGAAAGAAGCGATGGATGCAGGC
AGTCTTGGCTTCAACACCGGCGAACCCCGTATACAGCTATACTTTCTGCTGGGGCTTGTATACGCA
CCAGTCACACCTATTCTCCTTCCATTCATAGTTATGTTCTTCGGCTTCGCTTATGTGGTGTACCGT
CATCAGATCATAAATGTTTACAACCAAGAGTATGAAAGTGGCGCCGCATTCTGGCCTGCTGTCCAT
GGTCGTGTTATTACTGCATTAGTAATCGCACAGCTGCTTATGATGGGACTGTTGAGCACAAAGCAA
GCATCCAGCACAACACCATTTCTCATTGCTCTTCCTGTCCTCACTATATGGTTCCATGTCTTCTGC
AACGGCCGCTATAAATCTGCGTTTGTCAAATATCCATTACAGGAAGCAATGATGAAAGATAGCCTG
GAACGAGCAAGTTCTCCAAACTTCAATTTCAGATCCTACCTCGAGAAAGCATATGTGCATCCAGTT
TTCAAAGGAGATGGCAACGATGATGATTATGAACAGTATCTGAGTGAAAACCAGGAAGCTGATGCT
GAGAATGTGTTAGTGCCTACAAGACGCCACTCTCGAAGAAATTCACCAGCAGTAAGCCGAGCAGCT
TCACCTGCTTTATCCGAGGAAGTTCAAAGCGTAGAGCATCGAGTGTGACACTTGCATGCCGATTAC
ATCTCATACTTGTTCTACAGTGGGCAAAGGAAGAAGGGCTAGCTGAAAAATTCTCACAGGAA

SEQ ID NO: 475, protein - Populus trichocarpa
MATLEDIGVSAAINLLSALIFLFLFAILRLQPFNDRVYFPKWYLKGLRNSPSRSRALVSRFVNLDC
RSYIQFLNWMPQALKMPEPELIDHAGLDSAVYLRIYLMGLKIFVPITILAWVVLVPVNYTNNALEA FIGURE 24 (continued)

EKMAANVTASDIDKLSISNVPLKSQRFWAHIVMAYAFTFWTCYVLLKEYEKVASMRLQFLSSERRR
PDQFTVLVRNVPPDPDESVSELVEHFFLVNHPDHYLTQQVVCNANNLASLVKKNEGMQNWLDYYRF
KYSRNRSQRPQTKTGFLGLWGAKVDAIDYYISEIEKLSKEITEEREKVLNDPNCIMPAAFVSFKTR
WGAAVCAQTQQSRNPTLWLTEWAPEPRDVYWPNLAIPYVSLSVRRLIIGVSFFFLAFFFMIPIAFV
QSLASIEGIEKSLPFLKPVIEVEFIKSVVQGFLPGIALKLFLILLPTLLMMMSKFEGLTSLSSLER
RSAMRYYIFIIINVFLGSILTGAAFEQLDSFIKQSASEIPKTIGVAIPMKATFFITYIMVDGWAGI
AGEVLMLKPLIIYHLKNFFLVKTEKDRKEAMDAGSLGFNTGEPRIQLYFLLGLVYAPVTPILLPFI
VMFFGFAYVVYRHQIINVYNQEYESGAAFWPAVHGRVITALVIAQLLMMGLLSTKQASSTTPFLIA
LPVLTIWFHVFCNGRYKSAFVKYPLQEAMMKDSLERASSPNFNFRSYLEKAYVHPVFKGDGNDDDY
EQYLSENQEADAENVLVPTRRHSRRNSPAVSRAASPALSEEVQSVEHRV

SEQ ID NO: 476, DNA - Populus trichocarpa
TTTGTTTTGGTTCTTTTTTTGAAGGTATAAATGGCAACGCTTGCAGATATAGCGGTTTCGGGGGCT
ATAAATTTACTGAGTGCATTCATTTTCTTATTGGCATTTGCAATTTTGAGGCTACAACCCTTCAAT
GATAGAGTTTACTTTCCAAAATGGTATCTGAAGGGCTTAAGAAGCAGCCCCTCGCGCTCTGGGCA
TTTGTTCGTAGGGTGGTGAATTTAGACTTTAGGTCATATATCCGGTTTTTAAATTGGATGCCGGAA
GCGCTTAAAATGCCGGAGCCTGAGCTTATTGATCATGCAGGGTTGGATTATGCTGTTTACTTGCGC
ATTTACTTGATGGGACTTAAAATTTTTGTGCCTATAACATTCCTTGCTTGGGCTATCCTGGTGCCA
GTCAATTACACTAATGATGCTCTAGAGGCAGCCAAGATGGTGGCCAATGTGACTGCTAGTGACATT
GACAAGCTTTCAATTTCGAATATACCACTTAAATCACAAAGATTTTGGACGCATATAGTGATGGCT
TATGCCTTTACTTTCTGGACGTGCTACGTGTTGCTAAGGGAGTATGAGAAAGTTGCTGCGATGAGG
TTGCAATTTCTTTCCTCAGAAAGACGTCGTCCAGATCAATTCACAGTCCTTGTTAGGAATGTACCT
CCAGATCCAGATGAAACTGTCAGTGAGCTTGTGGAGCACTTTTTTCTAGTGAATCATCCAGATCAT
TACCTCACTCATCGGGTGGTGTGCAATGCCAACAAACTAGCCAGCTTGGTGAAGAAGAAGAAAAAA
AAGCAGAACTGGCTTGACTACTACCAACTCAAGTACTCCAGGAATCAATCGCAGAGGCCTCAGATG
AAGACTGGTTTCCTTGGGCATTTTGGGGGAAAAGTGGATGCAATCGATCATCACATTTCAGAGATT
GAGGAACTGTCAAAAGAAATAGAAGAAGAGAGGACAAGGGTTTTAAAGGATCCAAAGTCTATCATG
CCAGCAGCATTTGTTTCATTCAAGACTCGATGGGGTGCAGCTGTGTGTGCACAAACTCAACAATCA
AGAAATCCAACTTTGTGGTTAACAGAGTGGGCTCCGGAGCCTCGCGATGTATATTGGCAAAACTTA
GCCATTCCATACATGTCACTCAAAGTTAAGAGGCTGATAATTGGAGTTGCTTTCTTTTTCCTTACC
TTCTTTTTCATGATACCTATTGCATCTGTACAAGCGCTAGCAAGTATTGAGGGAATAGAGAAAAGA
GCCCCTTTTCTGAAGTCTGTTATTGAAATAAAATTTATCAAATCTGTCATCCAAGGTTTTCTTCCT
GGCATTGCATTGAAGCTCTTCCTTATCTTCCTGCCAACAATATTGATGATCATGTCTAAGTTTGAA
GGCTTCGTATCTCTATCTTCTTTGGAAAGGAGATCAGCAACGAGATACTATATTTTCCTCATTATC
AACGTATTCCTAGGGAGCATACTCACTGGAGCCGCATTTGATCAGCTAAATGCTTTTATTAATCAG
TCTGCTAACGAAATTCCTAAAACAATTGGTGTAGCTGTTCCAATGAAAGCAACTTTCTTCATAACC
TATATAATGGTTGATGGATGGGCTGGGATTGCTGGGGAAGTTTTAATGTTGAAACCACTGATATTC
TACCACTTGAAAAATTTCCTTTTGGTGAAGACTGAAAAAGACAGGGAAGAGGCAATGGATCCTGGA
AGTCTTGGTTTTCACACCGGCGAACCCCGTATACAATTATATTTTCTGCTAGGGCTTGTATATGCA
ACAGTGACACCAGTTCTCCTTCCATTCATAGTTATTTTCTTCGCCTTCGCCTATTTAGTGTTCCGT
CATCAGATCATAAATGTTTACAACCACGAGTATGAAAGTGGTGCAGCATTCTGGCCTGATGTCCAT
GGGCGTGTTATTACTGCACTAGTAATCTCGCAGCTGGCTCTGATGGGACTGATGAGTACAAAAGAA
GCTGCACAGTCAACACCATTTCTCATTGCTCTCCCTGTCCTCACTATATGGTTTCATAGGTTCTGC
AATGGACGCCACAAATCTGCATTTGTCAAATATCCATTACAGGAAGCAATGATGAAAGATACCCTG
GAACGAGCAAGGGATCCAAACTTTAATCTGAAAGCCTACCTTCAGAGTGCTTATGTTCATCCAGTT
TTCAAAGGTGGTGATGATGATATTGATGAAGACGACCTTCTGAGCGGAAAGATGGAAACCGAGAGT
GTCTTAGTGCCTACAAAGCGCCAATCACGAAGAAATACACCAGCACCAAGCAAAATCAGCGGGGGA
TCCTCACCATCTTTGCCCGAGACAGTTAAAAATGGAGAGCCTTGAAACAGAGATCGTTACACGTGC
ATGACTACACCTCGCAGTACATTAGACACAATCCATTGCCAGGAGACAGTGATCCGTTG

SEQ ID NO: 477, protein - Populus trichocarpa
MATLADIAVSGAINLLSAFIFLLAFAILRLQPFNDRVYFPKWYLKGLRSSPSRSGAFVRRVVNLDF
RSYIRFLNWMPEALKMPEPELIDHAGLDYAVYLRIYLMGLKIFVPITFLAWAILVPVNYTNDALEA
AKMVANVTASDIDKLSISNIPLKSQRFWTHIVMAYAFTFWTCYVLLREYEKVAAMRLQFLSSERRR
PDQFTVLVRNVPPDPDETVSELVEHFFLVNHPDHYLTHRVVCNANKLASLVKKKKKKQNWLDYYQL
KYSRNQSQRPQMKTGFLGHFGGKVDAIDHHISEIEELSKEIEEERTRVLKDPKSIMPAAFVSFKTR
WGAAVCAQTQQSRNPTLWLTEWAPEPRDVYWQNLAIPYMSLKVKRLIIGVAFFFLTFFFMIPIASV
QALASIEGIEKRAPFLKSVIEIKFIKSVIQGFLPGIALKLFLIFLPTILMIMSKFEGFVSLSSLER
RSATRYYIFLIINVFLGSILTGAAFDQLNAFINQSANEIPKTIGVAVPMKATFFITYIMVDGWAGI
AGEVLMLKPLIFYHLKNFLLVKTEKDREEAMDPGSLGFHTGEPRIQLYFLLGLVYATVTPVLLPFI
VIFFAFAYLVFRHQIINVYNHEYESGAAFWPDVHGRVITALVISQLALMGLMSTKEAAQSTPFLIA
LPVLTIWFHRFCNGRHKSAFVKYPLQEAMMKDTLERARDPNFNLKAYLQSAYVHPVFKGGDDDIDE
DDLLSGKMETESVLVPTKRQSRRNTPAPSKISGGSSPSLPETVKNGEP

SEQ ID NO: 478, DNA - Populus trichocarpa
CTATCTCTCTCTGTCCTTCTATTGTCTACCATGGCAACTCTTCAGGACATAGGAGTCTCAGCTCTC
ATTAACATTCTTGGTGCTTTTGCATTCTTGCTAGCTTTTGCTCTCCTCAGAATCCAACCCATCAAT
GACAGAGTTTACTTTCCGAAGTGGTACATTAGTGGAGGAAGGAGCAACCCAAGAAGGGCTGGTAAC
TTTGTGGGCAAATTTGTCAACCTCAATGTCAAGACTTACTTTACTTTCTTGAATTGGATGCCTCAA
GCCTTGAAGATGACCGAAGCAGAGATTATCAATCATGCTGGTCTTGACTCTGCTGTTTTTTTGAGG
ATTTACACTCTCGGCTTAAAGATTTTTGTGCCAATTACAATCCTTGCGCTCTTAATTCTCATTCCA
GTGAATGTATCTAGCGGAACACTATTCTTCTTAAGGAAAGAATTGGTTATGAGTGACATTGACAAG
CTTTCGATATCAAATGTTCGTCCTCAATCCATAAGGCAAGTTTTTGCATTTGCATATGAAGAAAAG
GGAAAATCCATGATTATGTTTTTTATCCACATAGCATTGGAATATGCATTCACTATATGGATTTGC
TTCATGCTCTACAAAGAATACGATCATGTAGCATTGATGAGATTGCGCTTCTTGGCTTCAAAAAGA
AGACATGCTGAACAGTTCACTGTAGTGGTGAGGAATGTCCCACATGTTTCTGGCCGGTCAGTATTA
GACACAGTGGAACAATTTTTTCAAACAAACCATCCAAATACTTATCTTTGTCAGCAGGCCGTCTAT
AATGCAAACAAATTTGCAAAGCTTGTGAGAAAAAGAGATAGACTTCAAAATTGGCTCGATTACAAC
CAGCTTAAATTTGAAAGACATCCAGACAAGAGGCCCACTCGAAAGAATGGTTTTCTAGGACTTTGG
GGTGAAAGAGTTGATTCTATTGAACACTACAAACAACAAATGAAGCATTTGGAGAAAAACATGGCA
TCGGAACGCCAAACAATTCTCAAAGACTCAAAATCTATATTGCCAGTTTCTTTTGTTTCTTTTAAT
TCGCGTTGGGGGCTGCTGTTTGTGCACAAACACAACAGAGCAAGAATCCGACTTTATGGTTGACA
AATTGGGCCCCAGAACCCCGTGATATTTATTGGCGTAATCTGGCTATACCGTTCATGTCATTGACA
GTCCGAAAGCTTATAATATCTGTGACAGTTTTTGCCTTGGTGTTTTTCTACATGATACCCATAGCT
TTTGTGCAATCCCTTGCAAACTTAGAGGGTCTCGAGAAAGTAGCTCCTTTCCTCAGGCCAGTCATA
GAATTGAAATTCATCAAGTCATTCCTACAAGGTTTCCTTCCTGGTCTAGCACTTAAAATCTTTTTG
TACATTCTACCAACAGTTTTGATGATAATGTCGAAAATCGAGGGATATATTGCACATTCAACTCTG
GAGCGAAGAGCAGCAGCAAAGTATTATTACTTTATGTTAGTGAACGTATTCTTGGGAAGCATAATT
GCTGGAACGGCTTTTGAGCAGCTGGATGCTTTTCTTCACCAATCACCAACCCAGATTCCTAGGACT
ATTGGGGTTTCCATACCAATGAAGGCTACCTTTTTCATTACATATATTATGGTTGATGGATGGGCT
GGTATTGCTGGAGAGATTCTCAGATTGAAGCCATTGATCATATTTCATCTTAAGAATATGTTTTTG
GTAAAGACTGAAAGAGACATAGAAAGGGCCATGGACCCTGGTAGTGTAGATTTCCCAGAGACTCTC
CCAAGCCTCCAACTATACTTTCTTTTGGGAATCGTGTATGCAGTGGTTACTCCAATACTGCTTCCT
TTTGTTCTAGTATTCTTTGCTTTTGCATACTTGGTTTACCGTCATCAGATAGTTAATGTCTACAAT
CAACAATACGAGAGTGCTGCTGCATTTTGGCCACATGTTCACAGCCGTATAATTGCAAGCTTATTG
ATATCTCAACTCTTACTTTTGGGCTTGCTCAGCACAAAAAAGGCAGCTAATTCCACTCCTTTGTTA
GTTATCTTGCCCGTATTGACGTTATCCTTCCACAAGTATTGCAAGATTCGCTTTGAGCCTGCATTT
AGGAAGTACCCTCTTGAGGAAGCCATGGCGAAAGATATAACAGACCGTACTGCAGAATCTGATATG FIGURE 24 (continued)

AACTTGAAAGCATATTTGGCTGATGCATATTTGCACCCAATTTTCCGTTCATTTGAAGAACCATTG
GTCGAGGTCAAGGTAGAAAAAAACAAACCACAAACTGCTAGTGATCGAATCAGTGAACTCAGCTCC
CCTTCTCCTCCACATCAAGTCAATCATCCTTCTTCCCCACCACATCAAGTCAATCATCCTTCTTCC
CCGCCACATTATGTCTATCATCCTTCTTCTCCACCTCAGCATGTCTATGACCCTTCCTCTCCATCC
CATTATGCGTATCATTACGAAAATGATATCTTTCATGCCCCCACCCCACCCCATTATGCCTATCAT
TACGAAAATGAGCCTTGATATTATGGAGCTACTAATCTACAAGATCGATTGCTAACCATTTTTGT
TTTTGTTTTTAAATTCCCAATTTCGGCTGCTC

SEQ ID NO: 479, protein - Populus trichocarpa
MATLQDIGVSALINILGAFAFLLAFALLRIQPINDRVYFPKWYISGGRSNPRRAGNFVGKFVNLNV
KTYFTFLNWMPQALKMTEAEIINHAGLDSAVFLRIYTLGLKIFVPITILALLILIPVNSSGTLFF
LRKELVMSDIDKLSISNVRPQSIRQVFAFAYEEKGKSMIMFFIHIALEYAFTIWICFMLYKEYDHV
ALMRLRFLASKRRHAEQFTVVVRNVPHVSGRSVLDTVEQFFQTNHPNTYLCQQAVYNANKFAKLVR
KRDRLQNWLDYNQLKFERHPDKRPTRKNGFLGLWGERVDSIEHYKQQMKHLEKNMASERQTILKDS
KSILPVSFVSFNSRWGAAVCAQTQQSKNPTLWLTNWAPEPRDIYWRNLAIPFMSLTVRKLIISVTV
FALVFFYMIPIAFVQSLANLEGLEKVAPFLRPVIELKFIKSFLQGFLPGLALKIFLYILPTVLMIM
SKIEGYIAHSTLERRAAAKYYYFMLVNVFLGSIIAGTAFEQLDAFLHQSPTQIPRTIGVSIPMKAT
FFITYIMVDGWAGIAGEILRLKPLIIFHLKNMFLVKTERDIERAMDPGSVDFPETLPSLQLYFLLG
IVYAVVTPILLPFVLVFFAFAYLVYRHQIVNVYNQQYESAAAFWPHVHSRIIASLLISQLLLLGLL
STKKAANSTPLLVILPVLTLSFHKYCKIRFEPAFRKYPLEEAMAKDITDRTAESDMNLKAYLADAY
LHPIFRSFEEPLVEVKVEKNKPQTASDRISELSSPSPPHQVNHPSSPPHQVNHPSSPPHYVYHPSS
PPQHVYDPSSPSHYAYHYENDIFHAPTPPHYAYHYENEP

SEQ ID NO: 480, DNA - Populus trichocarpa
ATTTCACAGTAATTCTGTTCTGAGCGAGTGATGGATTTCTCATCTTTCTTGACGTCTTTAGGGACG
TCGTTTTTGATTTTCGTAGTGTTAATGCTTCTGTTTACATGGCTGTCGAGGAAGCCTGGAAACTCC
TTCGTGTATTACCCCAACCGGATCTTGAAAGGTCTGGAACCCTGGGATGGCGCGTCAAGATCCCGC
AACCCGTTTGCTTGGATCCGGGAAGCCTTCTCTTCCAGCGAGCAGGACGTTATAAACATGTCCGGT
GTAGACACTGCTGTCTACTTTGTCTTCTTGAGCACTGCTCTGGCAATATTGGTTTTGTCTGGCCTT
GTTCTGCTGCCGGTACTTCTGCCTGTTGCTGCCACCGACGACAATGTGAAAACACAAAAAGATAAA
GGCAATCAGAGTTTTAGTGACATTGACAAGTTATTAATGGGAAATGTTAAGGGGGGGAGTCCAAGG
CTGTGGGCATTCTTGATTGCTACCTATTGGGTTTCTCTTGTTACCTATTTCTTGCTATGGAAGGCG
TACGTGCATGTTTCTGGGCTGAGAGCAAATGCTCTAATGTCTCCTGAACTGACACCAGAGCAATTC
GCTGTTCTTGTCAGAGACATACCTCCTGTCCCTGAGGGCCGAACTAGAAAGGAACAGGTTGATTCA
TATTTTAAATCCATCTATCCTGAGACATTTTATAGATCAATGGTGGTGACAAACAACAAAGAGGTT
AACAAGATTTATATAGAGTTGGAAGGATACAAGAAGAAGCTTGCACATGCAGAAGCTGTATACGAT
GAATCCAAAAAAACAGGCAAACCAGAAGGATTGAGACCAACCATCAGAACTGGCCCCCTTGGTATT
GTTGGTAGAAAGGTAGATAGCATAGAGCACTACAATGAGAAGATTAAAGAGCTAATCCCAAAGTTG
GAAGCTGAACAGAAAGTCACTCTCCGGGAGAATCAACAAGCTTGTGCTTTTGCCTTCTTCACCAAT
AGGGTGACTGCAGCTTCTGCCGCCCAGAGTCTACATGCCCAAATGGTTGACACCTGGACTGTCATG
GAAGCCCCTGAACCACGTCAAATAATATGGTCTAATCTTAAAATTAAGTATTTTCAAAGGATAATC
CGGCAGTATGTTGTTTGTTTATTGTGGCTCTGACCATATTGTTTATATGATACCAATCGGGCTC
ATTTCCGCATTAACAACCCTGGATAATCTGAAGAAAATTCTCCCATTTTTAAAGCCAATTGTGAAT
ATTGTCGCAGTTAAGACGGTGCTGGAAGCGTACCTTCCTCAGATTGCACTCATTGTGTTTTGGCA
CTGTTGCCCAAGTTACTTTTGGCTCTCTCCAAGGCTGAGGGAATTCCTTCAGTGGGCCATGCAGTA
AGGGCCACTTCTGGAAAATATTTCTATTTTACCATACTGAACGTTTTTATTGGAGTGACACTGGGT
GGCACCTTATTCACCACGTTCAAGAGCATTGAGGAGAAACCAAACTCCATTGTTAGTTTGCTTGCG
AGTAGCCTCCCGGGGAATGCAACTTTCTTCCTGACTTTTGTGGCTCTGAAGTTTTCGTTGGCTAT

FIGURE 24 (continued)

```
GGACTCGAGCTGTCTCGTATAGTTCCTCTAATCATTTTTCATCTAAAGAAGAAGTATCTTTGCAAG
ACCGAAGCGGAGTTAAAAGAAGCTTGGTTTCCTGGAGATTTAGGGTATGCAACCCGGATTCCTGGT
GACATGCTTGTTCTCACAATTGTTCTTTGCTACTCTGTCATAGCCCCTCTGATTATTCCATTTGGA
GTGGTGTACTTTGGCCTGGGATGGCTTGTCCTTAGGAATCAGGCACTCAAAGTATATGCTCCATCC
TTTGAGACCTATGGCAGGATGTGGCCCCACATCCACACAAGAGTCATTGCTGCTCTGATATTATTC
CAAGTTACAATGTTCGGTTATTTTGTGGTGAAGAAATTCTCCTTCAGTACTTTCTTACTAATTCCA
CTGCCGATACTTTCCTTGCTGTTCGCCTATGTCTGTCACAAGAAATTCTATCGATCTTTCTCTGAC
ACAGCCCTTGAAGTTGCTTGCCGTGAATTGAAGGAAATTCCTAACATGGAACGCATCTACAGATCT
TTTATCCCACCAAGCTTGAGCTCTGAAAAGGCCGATGATGACCACTTCGAAGATGCATTATCACAA
GTTTCAAGAGTCGGATCGTTTGCATGATATTACTGTGTTGGTAGCTAGCTAATTGCTCGATGAAGT
CTTGTAGTACCTTTAGCTTCTAAAACTTGGACCATTTGTCG
```

SEQ ID NO: 481, protein - Populus trichocarpa
```
MDFSSFLTSLGTSFLIFVVLMLLFTWLSRKPGNSFVYYPNRILKGLEPWDGASRSRNPFAWIREAF
SSSEQDVINMSGVDTAVYFVFLSTALAILVLSGLVLLPVLLPVAATDDNVKTQKDKGNQSFSDIDK
LLMGNVKGGSPRLWAFLIATYWVSLVTYFLLWKAYVHVSGLRANALMSPELTPEQFAVLVRDIPPV
PEGRTRKEQVDSYFKSIYPETFYRSMVVTNNKEVNKIYIELEGYKKKLAHAEAVYDESKKTGKPEG
LRPTIRTGPLGIVGRKVDSIEHYNEKIKELIPKLEAEQKVTLRENQQACAFAFFTNRVTAASAAQS
LHAQMVDTWTVMEAPEPRQIIWSNLKIKYFQRIIRQYVVCFIVALTILFYMIPIGLISALTTLDNL
KKILPFLKPIVNIVAVKTVLEAYLPQIALIVFLALLPKLLLALSKAEGIPSVGHAVRATSGKYFYF
TILNVFIGVTLGGTLFTTFKSIEEKPNSIVSLLASSLPGNATFFLTFVALKFFVGYGLELSRIVPL
IIFHLKKKYLCKTEAELKEAWFPGDLGYATRIPGDMLVLTIVLCYSVIAPLIIPFGVVYFGLGWLV
LRNQALKVYAPSFETYGRMWPHIHTRVIAALILFQVTMFGYFVVKKFSFSTFLLIPLPILSLLFAY
VCHKKFYRSFSDTALEVACRELKEIPNMERIYRSFIPPSLSSEKADDDHFEDALSQVSRVGSFA
```

SEQ ID NO: 482, DNA - Populus trichocarpa
```
ATTTTGGCAGATAAAAACAGTGGAGATTAGATGGACATTGGTGCCCTTTTAACTTCGGCCGCTATC
AATACAGGTTTATCTGTGTTGCTTTTTTCACTGTATTCAATATTGAGAAAACAACCAAGCAACACG
ATTGTGTATTTCGGGCGGAGGCTTGCTTCTTTAAACAACAGAAATAGCAGAAATCATTTCTCCTTC
GAAAGGTTTGTGCCCTCTCCCAGTTGGATCGTCAAGGCATGGGAAACAACAGAAAATGAAATCTTG
GCCATTGGTGGCCTTGATGCTGTGGTTTTCCAGAGGATACTTGTTTTCAGTTGTATACAGTATCAG
AGTCTTTTCTATTGCAGCTGTTACGTGTCTGTTCCTGGTGCTTCCAGTGAATTATTATGGGCAGGA
GATGAAACACAAGCATATCCATGCCGAGTCCCTCAATGTATTTACAATTGCAAATGTGAAAGAAGG
CTCCAGATGGCTTTGGGCACACTGTCTCGCATTATATATCATATCCTGCTCAGCTTGTGTTCTTCT
TTACTTTTTGTGTGTACCAATGTGTTAAGATTATTAACAACACCCCCTTCTCTCCAGGAATACAAA
AGCATCACCAAGATGAGGCTAGCACACATAACAACATCTCCTCCAAATCCAAGTCATTTTACCATT
CTTGTCCGTTCAATTCCATATTCAGTGGGAGAATCATACAGTAATTCTGTGAAGAAATTCTTTACA
AATTATTATGCATCGAGCTACTTGTCTCATCAAATTGTGTATCGATGTGGTTTAGTTCAAAAATTG
ATGGTTGATGCAGAAAAGATATGCATGAGGATTAAGGCTGCTCCCAAGGGCCAATCAAGTTTAAAG
CCATGTTGTCTGTGTGGAGGAAGTACTTCGTTTAAGGTCCTCACTGATGAACCAGAAAGTGTCAAG
GACAGTTTCAGTTATTCTAATTTGAATCTTGCCACCAGAGATAATGAGCGTTCTGCTGCTTTTGTT
ATTTTCAAGACCCGCTATGCTGCTGTGGTTGCCACACAGATGCTTCAATCACCAAATCCCATGTCA
TGGGTGACAGAATTGGCCCCAGAACCACATGATGTTTTATGGTCAAATCTCTGTATACCATTTAGA
CAGCTTTGGCTCCGGAAGATAGCAACTCTTCTGGCATCTATAGTCTTCATGGTTCTGTTTCTTGCT
CCAGTGACCTTTGTACAAGGCTTGACTCAACTAGAGAAGCTGTCACAAACATTTCCTTTTCTGAGA
GGGTTTCTAAAACATGTAGGAGACATTCCTGTAGAACTTGCCAAAGCAATACCAAATCAGGCTAGC
TTCTTTGTGACTTATGTTTAACATCAGGTTGGGCAAGTCTGTCATGTGAAGTGATGCAACCTTTT
TCTCTCCTCTGCAATTTCCTTAAAAAACACCTTCTTAGAAACCATGAAGACTCATCTGATGGTCTT
```

FIGURE 24 (continued)

```
GTGTCCTTTCCATACCATACTGAAGTTCCAAGAGTCTTGCTGTTTGGTCTCATTGGCTTCACCTAT
TCGGTTATGGCACCTTTAATATTGCCCTTCTTGCTGATTTACTTTTTACTGGCATATCTGGTATAT
CGAAATCAGATTGTCAATGTATACATAACAAAGTATGAAGGCGGTGGACAGTTGTGGCCTATTGTT
CACAACACCACAATCTTTTCATTGGTGCTGACACAAATGATATCTCTTGGTGTTTTTGGAATTAAA
AAATCTCCAGTCGCATCGGGTTTCACCATTCCATTGATAATTTGCACACTTCTATTTAATGAGTAT
TGCAGGCAGCGATTTTTCCCAATTTTTAAGAAGAATGTTGCACAGGTGATCATGAGGAACTGGTTT
GCTTTTGAATCTCTCTCTTCCTGTCTGTCCAAAGTTAATAAATTATTTTGTCCTGTTCAGGTTCTT
TTAGAGATGGATAGACGAGATGAGCAGTCTGGGCGGATGGAAGAGATCCATCAACAGTTGCATTCA
GCCTACTGTCAGTTACCGCTAACTTCCCATGAATTCTGTGAATCTGTACACAAGCTCTGTCAGGAC
AACATCCGAGGCCGAGAGGGCACCAAGTCAGGAAAAGAACCAAGTGAAGTAAGTGAACCCTGTGCT
GTCTGCAATTTTGGAAAAGAAGGTTCTATTGGGGAGTGATCTAGCTTATCCCCTGTACATATAAAC
GCCATCTACACACTGATGGTACTTTCCAGTGCAAAGGTATTTTGAAGAGAAGT
```

SEQ ID NO: 483, protein - Populus trichocarpa
```
MDIGALLTSAAINTGLSVLLFSLYSILRKQPSNTIVYFGRRLASLNNRNSRNHFSFERFVPSPSWI
VKAWETTENEILAIGGLDAVVFQRILVFSCIQYQSLFYCSCYVSVPGASSELLWAGDETQAYPCRV
PQCIYNCKCERRLQMALGTLSRIIYHILLSLCSSLLFVCTNVLRLLTTPPSLQEYKSITKMRLAHI
TTSPPNPSHFTILVRSIPYSVGESYSNSVKKFFTNYYASSYLSHQIVYRCGLVQKLMVDAEKICMR
IKAAPKGQSSLKPCCLCGGSTSFKVLTDEPESVKDSFSYSNLNLATRDNERSAAFVIFKTRYAAVV
ATQMLQSPNPMSWVTELAPEPHDVLWSNLCIPFRQLWLRKIATLLASIVFMVLFLAPVTFVQGLTQ
LEKLSQTFPFLRGFLKHVGDIPVELAKAIPNQASFFVTYVLTSGWASLSCEVMQPFSLLCNFLKKH
LLRNHEDSSDGLVSFPYHTEVPRVLLFGLIGFTYSVMAPLILPFLLIYFLLAYLVYRNQIVNVYIT
KYEGGGQLWPIVHNTTIFSLVLTQMISLGVFGIKKSPVASGFTIPLIICTLLFNEYCRQRFFPIFK
KNVAQVIMRNWFAFESLSSCLSKVNKLFCPVQVLLEMDRRDEQSGRMEEIHQQLHSAYCQLPLTSH
EFCESVHKLCQDNIRGREGTKSGKEPSEVSEPCAVCNFGKEGSIGE
```

SEQ ID NO: 484, DNA - Populus trichocarpa
```
AAAGTGGATAGATAGATAGACAGAAAACATATGGCGACACTGAGTGATATAGGAGTAGCAGCAGCT
ATTAACATTCTCACTGCGTTTGCTTTCTTCTTCGCATTTGCAATTCTCCGGATTCAACCAGTCAAT
GATAGGGTCTACTTTCCCAAATGGTATATCAAGGGGTTAAGGAGCAGTCCTTTCGGCACTGGTGCC
TTTGTTGGCAAGGTTGTCAATTTGGACTTCAGGTCATATGTGAGGTTTCTCAACTGGATGCCTGCG
GCATTACATATGCCGGAACCTGAGCTCATTGACCATGCTGGATTGGACTCTGCTGTTTACTTGAGG
ATTTACCTGATAGGGCTTAAGATTTTTGTTCCTATTGCATTCCTGGCCTTCACTATCCTGGTGCCA
GTGAACTGGACAAATAGCACTTTGGAGCGTTCTAATTTGACTTACAGTGATTTAGATAAGCTCTCT
ATTTCAAATATACCCACAGGATCAAACAGATTCTGGACCCATTTGGTGATGGCCTATGCCTCTACC
TTTTGGACATGCTATGTGCTAAAAAAGAGTATGAGATAGTGGCTAAAATGAGGTTGCATTTTCTT
GCATCAGAAAAACGACGTCCTGATCAATTTACAGTACTGGTTAGAAATGTGCCACCAGATGCTGAT
GAATCGGTTAGTGAACTCGTGGAGCACTTTTTCCTAGTCAACCATCCTAATGATTATCTCACTTAC
CAGGTTGTCTACAATGCTAATCAACTTTCTCACCTAGTCAACGAGAAGAAAAAGATGAAGAACTGG
CTTGACTATTATCAAATCAAATATTCAAGAAACAAATCCAGAATGCCCTCCCTCAAGACTGGTTTT
CTTGGCCTTTTCGGGACTAGGGTGGATGCAATTGATCATTATACATCTGAGATTGAGAGACTGTCT
AGAAAAATCTCCTTGGAGAGAGATGAGATTGTGAACAATGCCAAGGCAATCATGCCAGCAGCATTT
GTTTCCTTCAAAACTCGATGGGGAGCTGCTGTTTGTGCACAAACACAACAATCCAGAAATCCAGCT
ATGTGGTTGACTGAGTGGGCTCCTGAACCCCGTGATGTATACTGGGACAACCTCGCAATTCCATTT
GTTTCACTGGCACTAAGAAGGCTCGTTATCGCTGTCACATTTTCTTCCTTACTTTCTTCTTTATG
GTTCCCATTGCATTTGTACAGTCCCTTGCAAACATTGAAGGAATTGAGAAAGCACTCCCGTTCCTG
AAACCTATAATTGAAATGAAAGTGATAAAGTCATTCATTCAAGGTTTCCTTCCTGGAATTGCTTTG
AAGATATTTCTTATTTTTCTACCCTCCATATTGATGCTAATGTCTAAATTTGAGGGATTCATTAGC
```

```
ATATCAGGCCTAGAGAGGAGATCTGCGGCTAGATATTATATCTTCCAGTTCATTAATGTATTTCTC
GGAAGCATAATCACCGGAACTGCATTTCAACAACTGGATAATTTTATCCACCAGTCTGCAACTGAA
ATACCAAAGACAATCGGAGTATCCATACCTATGAAAGCAACTTTCTTCATAACTTACATCATGGTT
GATGGGTGGGCTGGAGTTGCTGGGGAGATTTTAAGATTGAAACCCTTGATAATCTATCACCTGAAA
ATGTTTTTCATGGTGAAGACCGAAAAGGACATGGAAGAGGCGATGGATCCAGGAACTCTTGGTTTC
AACACAGGGGAACCACAAATACAACTTTATTTCTTACTTGGCCTCGTTTATGCTGTGGTGTCGCCC
ATCTTACTTCCTTTCATTATAGTATTCTTTGCCCTCGCATTTGTTGTGTATCGTCATCAGATTATA
AATGTTTACAATCAGGAGTATGAGAGTGCTGCAGCATTCTGGCCTGATGTCCATGGACGCATCATA
GTAGCAGTAATTGTCTCACAGCTGCTGCTAATGGGATTGTTAAGCACAAAAGAAGCGGCTCAGTCA
ACACCGTTGCTCATTACACTCCCAGTATTGACAATATGGTTCCATTTGTTCTGCAAAGGCCGTTAT
GAACCTGCTTTTGTTAGATATCCATTGCAGGAAGCAATGATGAAAGATACATTGGAACGCGCCAAA
GAGCCCAACCTGAACTTGAAAAGCTTCCTTCAAAACGCTTACATCCACCCAGTTTTTAAAGGCGAA
GACGATAGTGACAGCGATGAAGCGCCTGAAGAGTTTGAGAAAGAACCTGATCTGGTCCCAACAAAG
CGCCAGTCTCGAAGGAATACACCATTGCCAAGTAAGCATGGCTCGGCTGCATCCTCCCAGCCTGAA
GCTCAGGATTATCCACTACTTTGAAACTCGTGTGTAAATGCGAGTCCTTGGAAAATTAAGCTGGCT
GAGCTCAGAAGAGATTGTACATGGGATAGTAGGCTAAG
```

SEQ ID NO: 485, protein - Populus trichocarpa
```
MATLSDIGVAAAINILTAFAFFFAFAILRIQPVNDRVYFPKWYIKGLRSSPFGTGAFVGKVVNLDF
RSYVRFLNWMPAALHMPEPELIDHAGLDSAVYLRIYLIGLKIFVPIAFLAFTILVPVNWTNSTLER
SNLTYSDLDKLSISNIPTGSNRFWTHLVMAYASTFWTCYVLKKEYEIVAKMRLHFLASEKRRPDQF
TVLVRNVPPDADESVSELVEHFFLVNHPNDYLTYQVVYNANQLSHLVNEKKKMKNWLDYYQIKYSR
NKSRMPSLKTGFLGLFGTRVDAIDHYTSEIERLSRKISLERDEIVNNAKAIMPAAFVSFKTRWGAA
VCAQTQQSRNPAMWLTEWAPEPRDVYWDNLAIPFVSLALRRLVIAVTFFFLTFFFMVPIAFVQSLA
NIEGIEKALPFLKPIIEMKVIKSFIQGFLPGIALKIFLIFLPSILMLSKFEGFISISGLERRSAA
RYYIFQFINVFLGSIITGTAFQQLDNFIHQSATEIPKTIGVSIPMKATFFITYIMVDGWAGVAGEI
LRLKPLIIYHLKMFFMVKTEKDMEEAMDPGTLGFNTGEPQIQLYFLLGLVYAVVSPILLPFIIVFF
ALAFVVYRHQIINVYNQEYESAAAFWPDVHGRIIVAVIVSQLLLMGLLSTKEAAQSTPLLITLPVL
TIWFHLFCKGRYEPAFVRYPLQEAMMKDTLERAKEPNLNLKSFLQNAYIHPVFKGEDDSDSDEAPE
EFEKEPDLVPTKRQSRRNTPLPSKHGSAASSQPEAQDYPLL
```

SEQ ID NO: 486, DNA - Populus trichocarpa
```
TGGTAGTGAGTCTGAATCTGAGTGATCAAAATGAATCCAGAAAGTCTTACTGCATCGGCAGCCATT
AACTTTGGCTTGGCATTCATAGTTCTCTCACTCTTCTCCATTTTCAAGAAACAACCTTCTAATGCC
TCCATTTACTACGCTCGTCGCCTCTCCAAACGACACCATGATCACTTTGAGCAGTCTTTCACTCTT
TCCCGCTTTCTTCCTTCAGTTGCTTGGATTCCTCGTGCTTTTCGAGTCACTGAAGATGAAGTTCTT
GATATTGGTGGCCTTGATGCTCTCATCATTATCAGACTCTTCAAATTTGGGATATATTTCTTTGGA
ATTTGTTCTCTTATTGGATTAGTGGTACTTCTGCCAATCAATTTCGGTGACCAAGATGAACAATCT
AGCATCTACCATTCCATGGATCCTTTCACAATATCAAATATTAGTGCAGGTTCGAACAGGTTGGGT
TTCCCATCTTGCTTATGGTTGTTCAGGCTTTGGGTGCATTTACGTGCTTGTGGTTGATATCATTT
TATGGATTATATCTGTTGTACAAGGAATATGACGGAATTTCGGTTAAACGGATCCAACTACTTCGG
AACCTAAGGCATCAACCTGATCGGTTTAATGTTCTTGTTCGGCAAGTTCCCTTCTGCAATGAACAC
AACGCTTATGGGTGCTCTGTTGATCACTTCTTCTCTAAACATCATCCTAACAGTTACTGTTCTTAT
CAGATGATATATGATGGAAAAGATATCGAAGATCTGCTGCACCAAGCAAAATGTTGCGAGAAAG
ATAGAGGACATGAGAGGAAAGCTCACAGTTAAGAAACGCGACAAGGAAAGCTTACTCTTAGATGTA
TCTCAAGAAGATGATGTGAAAATAGCTTTGTTTGAGGAAAAGCAGCAAGAAAATGTTCGTAAGATT
CGTCAATTACAGAACGAAAGTATGCTGAAAGGAAAGGAGTTGCCTGTTGCCTTTGTTACATTCAAG
TCCCGACGTGGTGCAGCATTAGTTTCCCAAACTCAACAGCACTCACATCCACTCATATGGATCACG
```

GAAATGGCTCCAGAACCAAGGGATGTATCATGGAGGAGTCTGGAAATTCCCTTTAAGATTTTGCCA
CTTTGCAAAATCGGGGTCGTTGTTGCAGCATCTCTCCTCACAATTTTCTTTGCAGTCCCAGTTACA
GCTGTTCAAGGAATAGCTAAACTTGAGAAACTTAAGAAATGGTTCCCCCCAGCCATGGCTATGGAG
CTAATACCAGGATTAAGCTCCATTATTACAGGGTATCTTCCAAGTGCCATTCTCAAAGGCTTTATA
TATGTTGTTCCCTTTGCAATGCTTGGCATGGCTAAATTAGGCGGTTCGATTTCAAAGAGCAAGGAG
GAGATTAAAGCTTGCAATATGGTTTTCTACTTTCTCGTGGGAATGTATTCTTTTTGAGTTTGATA
TCAGGATCCCTACTTGATGAGCTTGGAGAATATTTTACCCACCCTAGGAGTATTCCTAGTCATCTT
GCCAGTGCTGTCTCTTCTCAAGCTGATTTTTTCGTGACATACATCTTAACAGATGGGTTGTCAGGA
TTTTCTTTGGAAATCCTTCAGCCCGGCTTGCTTGTTTGGGATGCCGTGAAATCACACACAGTTGGC
GGATCAGGAGACGAGGAAAATCCTTACCTTTATTCATTGCCCTATTTTAGAATCATCCCTTCAGTC
TCCCTATCAATACTCATTGGTATGGTATATGCAGTTGTCGCTCCATTGCTGCTTCCATTTCTTGTT
GGCTACTTCTATCTAGGCTACGTTGTATATGTCAACCAGATTGAAGATGTTTACGAAACTGCTTAT
GATACATGCGGACAGTATTGGCCATACGTTCATCATTATATATTCGTCGGAATCATTCTTATGCAA
ATCACCATGATTGGTCTTTTTGGGCTGAAGTCAAAACCTTCTGCTTCCATAGCCACAATTCCACTC
TTATTGCTTACTATAATGTTCAATGAGTACTGCAAGATACGTTTTCTACCTACTTTTCGCCACTAT
TCTGTTAAGGATGCGGATGAACATGATGAACTAGATAGGAAGTTCGGTAAGATGGAAATAAATTGT
GAGAATGCCAGAAGTGCCTATTGTCAGCCCACTTTACAACCAGCAAACTTCATGGCATCAAAGTCT
ACTTCCTCGCAGCCATTGGTTTCTTCATTGTGATATCTTAACATTGTAATTCATTTTCTTCCTTTC
TCTTGTACTTTCGAGTACATTCACCTGAGTTTTCCGAAAAATTATTA

SEQ ID NO: 487, protein - Populus trichocarpa
MNPESLTASAAINFGLAFIVLSLFSIFKKQPSNASIYYARRLSKRHHDHFEQSFTLSRFLPSVAWI
PRAFRVTEDEVLDIGGLDALIIIRLFKFGIYFFGICSLIGLVVLLPINFGDQDEQSSIYHSMDPFT
ISNISAGSNRLGFPSCLWLFRLWVHFTCLWLISFYGLYLLYKEYDGISVKRIQLLRNLRHQPDRFN
VLVRQVPFCNEHNAYGCSVDHFFSKHHPNSYCSYQMIYDGKDIEDLLHQAKYVARKIEDMRGKLTV
KKRDKESLLLDVSQEDDVKIALFEEKQQENVRKIRQLQNESMLKGKELPVAFVTFKSRRGAALVSQ
TQQHSHPLIWITEMAPEPRDVSWRSLEIPFKILPLCKIGVVVAASLLTIFFAVPVTAVQGIAKLEK
LKKWFPPAMAMELIPGLSSIITGYLPSAILKGFIYVVPFAMLGMAKLGGSISKSKEEIKACNMVFY
FLVGNVFFLSLISGSLLDELGEYFTHPRSIPSHLASAVSSQADFFVTYILTDGLSGFSLEILQPGL
LVWDAVKSHTVGGSGDEENPYLYSLPYFRIIPSVSLSILIGMVYAVVAPLLLPFLVGYFYLGYVVY
VNQIEDVYETAYDTCGQYWPYVHHYIFVGIILMQITMIGLFGLKSKPSASIATIPLLLLTIMFNEY
CKIRFLPTFRHYSVKDADEHDELDRKFGKMEINCENARSAYCQPTLQPANFMASKSTSSQPLVSSL

SEQ ID NO: 488, DNA - Populus trichocarpa
CCACTCAAAATTGTTGATAAAAATTGCTTAATGCATGTATTTGATGCCCATATGTTTCAGATGGCA
TCGGAGCGCCAAAAAATTCTTGAAGACTCAAAATCTATCTTGCCAGTTTCTTTTGTTTCTTTTAAT
TCACGCTGGGGGCAGCTGTTTGTGCACAAACACAACAAAGCAAGAACCCAACATTATGGCTGACA
AATTGGGCTCCAGAACCTCGCGATATCTATTGGCGTAATTTGGCTATACCATTCGTGTCACTGACT
GTTCGAAAGCTTATAATATCTTTGTCAGTGTTTGCTTTGGTGTTTTTCTACATGATACCTATAGCT
TTTGTGCAATCCCTTGCAAATTTAGAGGGTCTTGAGAAAGTTGCTCCTTTCCTTAGGCCGGTCATA
GAACTGAAATTCATCAAGTCATTCCTACAGGGTTTCCTTCCTGGTCTTGCACTTAAAATCTTTTTG
TATATACTACCAGCGGTTTTGATGATAATGTCAAAAATCGAGGGATATATTGCACATTCAACTTTG
GAGCGAAGAGCAGCAGCAAAGTATTATTACTTTATGTTAGTGAATGTATTCTTGGGAGCATAATA
GCTGGAACGGCATTCGAGCAGCTGGATGCTTTCCTTCACCAATCACCAACCCAGATTCCTAGAACT
ATTGGGGTTTCCATACCAATGAAGGCTACCTTTTTCATTACATATATAATGGTTGATGGATGGGCT
GGTATTGCTGGAGAGATTCTCAGATTGAAGCCATTGATCATATTTCATCTTAAGAACATGTTTTTG
GTAAAGACTGAAAGAGACAGAGAAAAGGCCATGAATCCTGGTAGTGTAGATTTCCCAGAGACTCTC
CCAAGCCTCCAACTATACTTTCTTTTGGGAATCGTATATGCTGTGGTTACTCCAATACTGCTTCCC

```
TTTATTCTAGTATTCTTTGCTTTCGCATACTTGGTTTACCGTCATCAGATAATCAATGTCTACAAT
CAACAATACGAGAGTGCTGCTGCATTTTGGCCACATGTTCACAGCCGTATAATTGCAAGTTTATTG
ATATCTCAACTTTTACTTTTGGGCTTGCTTAGTACAAAAAAAGCAGCCAATTCCACTCCTTTGTTA
GTTATCTTGCCCATATTGACATTATCTTTCCACAAGTTCTGTAAGAGTCGCTTCGAACCTGCATTT
AGGAGGTACCCTCTTGAGGAAGCCATGGAGAAAGACATATTAGATCGAACTACAGAATCTGATATA
AACTTGAAAGCATACTTGGCTGATGCATATTTGCACCCAATTTTCCACTCATTTGAGGAAGAAGAG
TTAGTTGAGGTTGAGGTTAAGGTTGAAAGAAACAAATCGCATACTGCAAGTGATCCAACCACCGAA
ATCAACCCCCCCTCTCCACCACATCAAGTCAACCATCCTTTTTCCCCACCGCATTACATGTATCAT
CCTTCTTCTCCACCTCAGCATGTCTATGAGCCTTCCTCTCCATCCCATTATGCCTATCATTACGAA
AATGATATCTACCATCCTCCCTCTCCACCCCATTATGCCTATCATTATGAAAACGAGCCTTGATAT
TATGGAGGTACTAATCTACAAGTTCAACTGCTAACCCTTTTTGTTTTATTTTCTCCAAATTTC
TAATTTCCACG
```

SEQ ID NO: 489, protein - Populus trichocarpa
```
MHVFDAHMFQMASERQKILEDSKSILPVSFVSFNSRWGAAVCAQTQQSKNPTLWLTNWAPEPRDIY
WRNLAIPFVSLTVRKLIISLSVFALVFFYMIPIAFVQSLANLEGLEKVAPFLRPVIELKFIKSFLQ
GFLPGLALKIFLYILPAVLMIMSKIEGYIAHSTLERRAAAKYYYFMLVNVFLGSIIAGTAFEQLDA
FLHQSPTQIPRTIGVSIPMKATFFITYIMVDGWAGIAGEILRLKPLIIFHLKNMFLVKTERDREKA
MNPGSVDFPETLPSLQLYFLLGIVYAVVTPILLPFILVFFAFAYLVYRHQIINVYNQQYESAAAFW
PHVHSRIIASLLISQLLLLGLLSTKKAANSTPLLVILPILTLSFHKFCKSRFEPAFRRYPLEEAME
KDILDRTTESDINLKAYLADAYLHPIFHSFEEEELVEVEVKVERNKSHTASDPTTEINPPSPPHQV
NHPFSPPHYMYHPSSPPQHVYEPSSPSHYAYHYENDIYHPPSPPHYAYHYENEP
```

SEQ ID NO: 490, DNA - Populus trichocarpa
```
ATTTGTGAGCTTCTTTTGAAGAAAAAAAAATGATACTTTCAGCTCTTTTAACTTCAGTTGGAATC
AATCTTGGACTGTGCTTGTTGTTTTTCACTTTGTATTCAATATTGAGGAAGCAACCTGGTAATTTT
TACGTGTATGCACCCCGTTTGGTCGATAAAGAGAAATCTCAGCCACAGGAGAGTGATGATTTTTAC
TTGGAAAGGTTATTGCCTTCTGCTGGTTGGGTTAGAAATGCTTGGCAGCTTTCTGAAGATGAAATC
TTGTCAATTTCGGGTTTAGATGGTCTCGTGTTAACTCGGATCTTCACCTTCAGCTTGAAAGTGTTC
ACCGTTGCTGGGGTTATTGGAATCTCCATCCTTCTTCCAATTAATTATTTGGGAACCAGCTAAGT
GATGATTTTGGCCATTTGCCGAACAAGTCTTTGGATTCATTTAGTATATCAAATGTCAATGACGGT
TCAAACAGGTTATGGGTTCACTTTTCTGCTGCATATATTTTACTGGAGTTGTCTGCTATCTTCTG
TATTACGAGCATAACTATATGTCAGCAAAAGGATTGCTTACTTCTATTCATCCAAACCGCAGCCT
CATCAGTTTACAATATTAGTCCGCAGTATCCCTTCCTCATCTGGAAAAAACTTTAGTGAAACTGTT
GAGAGTTTTTTCACAGAGTATCATCCTTCTACTTATCTTTCACATTCAATGGTTCATCGAACAAGC
AAAATTCAAGATCTCATTAATGATGCGGACAAATTGTATAGAAAGCTTGACTGCATGAAATCAAAC
AACCATTCTCAGCAAAACTTCAGACGTGATGGCTTTTTAGGACTCACTGGACGCAAAGTTAATCTT
TTAGACCTCTATGAAAAGAAGTTGGAAGATTTGGAAGATAATTTGAGGAAGGAGCAAAATTTATTG
GCTGGAGAGGAAGTTCCAGCCGCTTTTGTTTCATTCAAGTCGCGGTTTGGTGCTGCAGTAGCCTTA
CACATCCAACAGGGGGTTAATCCCACAGAATGGGTCACTGAGCGAGCTCCTGAGCCTCAGGATGTT
CACTGGGCTTTCTTTTCTGCATCATTCATTAAAGATGGATCTTCAAACTGGTGAACTGTTGTCAG
TCAAGTAATTACAGGATATCTTCCAAGTCTCATTCTGCAGTTATTTCTTTCTTTTGTTCCACCAAT
TATGTTAACATTTTCCGCCATTCAAGGATACATTTCTCGCAGTCAAATAGAAAGAAGTTCTTGTTC
CAAGATGCTATGGTTTATCATATGGAACATCTTCTTTGCAAATGTACTGTCAGGGTCAGCTTTGTA
TCTAGTCAATGTCTTCCTTGAGCCCAAAAATATTCCAGGGTGCTAGCTGAAGCTGTCCCAGGTCA
GGTGGGAATGCATCTCTGTTCTGTATATTCTTTTA
```

FIGURE 24 (continued)

SEQ ID NO: 491, protein - Populus trichocarpa
MILSALLTSVGINLGLCLLFFTLYSILRKQPGNFYVYAPRLVDKEKSQPQESDDFYLERLLPSAGW
VRNAWQLSEDEILSISGLDGLVLTRIFTFSLKVFTVAGVIGISILLPINYFGNQLSDDFGHLPNKS
LDSFSISNVNDGSNRLWVHFSAAYIFTGVVCYLLYYEHNYMSAKRIAYFYSSKPQPHQFTILVRSI
PSSSGKNFSETVESFFTEYHPSTYLSHSMVHRTSKIQDLINDADKLYRKLDCMKSNNHSQQNFRRD
GFLGLTGRKVNLLDLYEKKLEDLEDNLRKEQNLLAGEEVPAAFVSFKSRFGAAVALHIQQGVNPTE
WVTERAPEPQDVHWAFFSASFIKRWIFKLVNCCQSSNYRISSKSHSAVISFFCSTNYVNIFRHSRI
HFSQSNRKKFLFQDAMVYHMEHLLCKCTVRVSFVSSQCLP

SEQ ID NO: 492, DNA - Populus trichocarpa
TTTTGGAGGTTTTGAGATTGGTATGCTGAAATGCTCGTTTCCGCTATTCTAACATCAGTGGGGATA
AACTCTGCTCTATGTGTTCTATTCGTTGTACTGTACTCTATACTGAAGAAACAACCAAGTTATTAT
GAAGTTTATATACCGCGCTTGCTGACGGAAGGGAATTCTAAACGGAGAAGCCGTTTCAACCTTGAA
AGGCTAATACCATCTACTGGCTGGTTGCCCAAGGCATGGAAACTATCGGAAGAGGAAATGTTGTCT
TCTTCAGGCTTGGACGCCGTGGTGTATATGCGAACTATAACTTTCTGTTTGAAAGTATTTTCATTC
GCTGGGATAATAGGGATATTTATTCTTCTTCCAGTGAACTGTTCGGGGACTGAGCTTCACCAAATT
GACTTCGAAGATTTGTATAGTAATTCTCTGGATGTATTCACCATTTCAAATGTAAATCGAGGCTCA
AAGTGGTTATGGATTCACTTCTCTTCTGTATATGCTATCACTATTTTCATCTGCTATCTACTTTAT
CATGAATATAACTATATTTCTTCAAAAAGGATTGCGTATTTTTATTCATCCAAACCTCAGCCACAT
CAGTTCACCATCTTAGTTCGCAATATCCCTGTCTCAGCTGGAAGCAGTGTCAGTGACAGTGTCGAG
AGCTTCTTTACCGAGTATTACCCTACCACATATCTGTCACATATAGTTGTTCGCCGAACTAGCAAA
GTTCAGAGCCTCATTAATGATGCAAAGCAATTATACAGGAGGCTTCTTCACTTGCAATCAGAACCA
TCTGAGCAGAAGTATAAGCAAGTTGGATTGTTTGAAAAAAGGTTGATCTTTTGGATCATTATGGG
AAGAGGTTAGAAGACTTAGAGCAGAATGCGAGATTGGAGCAATCTGAGGTATCATTGGCAAAAGAC
ACTCATGCTGCCTTTGTGTCCTTCAAGACTCGGTATGGTGCTTCCACTGTTTTCCACCTGCAACAA
TCAACCAACCCCACACATTGGCTCACAGAAGAAGCTCCTCAACCAAATGACGTCTTTTGGCCTTTT
TTTTCTTCATCATTCATGGGAAGATGGATTTCTAAGCTTTTGGTTGTAGTTGCGTGTATTCTTCTT
ACAATTTTGTTCCTTATTCCTGTTGTAGTTGTACAAGGTCTTACTAACCTGAGTCAGCTGGAAGTT
TGGTTTCCATTCCTCAAAAGCATTCTAACCTTAGCATTTGTCAGTCAAATAGTTACAGGATATCTT
CCTAGTCTGATTCTTATGTTGTTCCTAAAGATCGTGCCCCAATCATGGAGTTCCTCTCCTCCATT
CAAGGATACATTTCTCATAGCGAGATAGAGAGGAGTGCATGCAACAAAGTACTCTGGTTCACAGTA
TGGAACATCTTCTTCGCCACTGTATTTTCCGGTTCCGTGTTAAATCAGATTTCCATTGCTCTTGAT
CCCAAGAATATTCCTACAAAACTGGCTGTTGTTGTTCCAGCACAGGCATCATTTTTCATTGCTTAT
GTTGTCACATCTGGATGGACAAGCACTTCATCGGAACTTTTTCGCATAATCCCTCTAATTTGCAGT
CTAATGACGAAGTGTTGTGCTGAAAGTACAGATGATGAAATTGAAGTTCCATCTATTCCTTATCAC
AGGGACATTCCCAGGATTCTTTTCTTTGGACTTCTTGGTATTGCATATTTCTTCTTAGCTCCCGTC
ATTCTGCCCTTCCTTCTGGTGTACTTCTGTCTTGCATACATCATCTTCCGTAACCAGTTCATAAAT
GTATATGCTCCCAAGCACGAAACTGCAGGGAAGTTTTGGCCTATCGTACACAATTTGGTGATATTT
TCTCTGGTACTCATGCATGCGATTGCAGTGGGAATCTTTTCTCTGAAGAAGCTCTCTCTCGCATCA
ACCTTAGTCTTACCTCTTCCAGTTCTCACGCTTCTGTTTAATGAGTACTGCAGGAAACGCTTCCTC
CCCATTTTTACAGCTTATCCAGCTGAGATATTGATAAAGAAGGACAGGGAAGATCAAAATGATGCT
ACGATGTCTGAATTTTTTGATAAATTGGCCACCACCTATCAGGACCCGGCTCTAATGCCGATTCAG
TACTCTGCAGACAGTGAAAGTCTTAACAGACCGCTTATACCATCTGCTGAAATGTCAATGTGAGGT
TGTCTTTGCACTGTATTGACTATTGAGCTGAATAGTAGTGGTGGTTTCTATTATCAACCACCATTT
CCATATGCTAC

SEQ ID NO: 493, protein - Populus trichocarpa
MLVSAILTSVGINSALCVLFVVLYSILKKQPSYYEVYIPRLLTEGNSKRRSRFNLERLIPSTGWLP
KAWKLSEEEMLSSSGLDAVVYMRTITFCLKVFSFAGIIGIFILLPVNCSGTELHQIDFEDLYSNSL FIGURE 24 (continued)

DVFTISNVNRGSKWLWIHFSSVYAITIFICYLLYHEYNYISSKRIAYFYSSKPQPHQFTILVRNIP
VSAGSSVSDSVESFFTEYYPTTYLSHIVVRRTSKVQSLINDAKQLYRRLLHLQSEPSEQKYKQVGL
FEKKVDLLDHYGKRLEDLEQNARLEQSEVSLAKDTHAAFVSFKTRYGASTVFHLQQSTNPTHWLTE
EAPQPNDVFWPFFSSSFMGRWISKLLVVVACILLTILFLIPVVVVQGLTNLSQLEVWFPFLKSILT
LAFVSQIVTGYLPSLILMLFLKIVPPIMEFLSSIQGYISHSEIERSACNKVLWFTVWNIFFATVFS
GSVLNQISIALDPKNIPTKLAVVVPAQASFFIAYVVTSGWTSTSSELFRIIPLICSLMTKCCAEST
DDEIEVPSIPYHRDIPRILFFGLLGIAYFFLAPVILPFLLVYFCLAYIIFRNQFINVYAPKHETAG
KFWPIVHNLVIFSLVLMHAIAVGIFSLKKLSLASTLVLPLPVLTLLFNEYCRKRFLPIFTAYPAEI
LIKKDREDQNDATMSEFFDKLATTYQDPALMPIQYSADSESLNRPLIPSAEMSM

SEQ ID NO: 494, DNA - Populus trichocarpa
TTCTTTTTGAAGAGTAAGTAGGAAACTTAAATGAATTGTAATAGCCACGTCTTGGCCAGAGGTAGA
GGAGTGAGTGAGCTTGTCTTTCTTCCAAAATTAGCTTTTTTTCTGGTGAATCATCCAGATCATTAT
CTCTCTCACCAGGTGGTGTGCAATGCTAACAATCTAGCCAGCTTGGTCAAGAAGAAGGAAAGCAAA
CAGAACTGGCTTGACTACTACCAAAACAATTTTGACCTCAATTTTTACTCTTCTCTGCTGTTTCAG
ACTGGCTTTCTTGGGCTTTGGGGGGCAAAAGTGGATGCAATTGATCATCATGTGTCGGAAATTGAG
AAACTGTCAAAAGAAATAGCAGAAGATAGGGAAAAGATTTTAAATGATCCGAATTCTATCATGCCA
GCTGCATTCGTTTCGTTCAAGACTCGATGGGGTGCAGCGTTTTGTGCACAAACTCAACAATCAAGA
AATCCAACTTTGTGGTTAACAGAGTGGGCTCCTGAGCCTCGCGATGTGTATTGGGAAACTTAGCC
ATTCCATATGTGTCACTTTCTGTTAGGAGGCTGATAGTTGGAGTTTCATTTTTTCTTGCCTTCTTA
TTCTTGATCCCTATTGCATTTGTACAATCTCTAGCAAGCATTGAGGGAATTGAGAAAAACCTTCCC
CTTTTGAAGCCTGTTATTGAAATAGAATTTATCAAATCAGTTGCCCAAGGATTTCTACCTGGGATT
GCACTGAAACTCTTTCTCACCTTCCTGCCGACAGTATTGATGATGATGTCTAAATTGGAAGGCTTC
ATGTCTCTATCATCTTTGGAAAGGATATCAGCAATGAGATATTACATTTTCATCATTATTGATGTG
TTCCTTGGAAGCATACTCACCGGGGCTGTGTTCGAACAGCTAAATTCTTTTATCAATCAAATTCCT
GAAACAATCAGTGTAGCTATTCCAATGAAAGCAACTTTCTTCATAACCTATTTAATGGTTGATGGA
TGGGCTGGAATGGCTGGAGAAATTCTAATGCTGAAACCACTGATAATTTACCACTTGAAGAATATC
TTTTTGGTGAAGACTGAGAAAGACAGGCAAGAGGCAATGGATGCTGGTAGTCTTGGTTTCAACACC
AGCGAAACCCGTATGCAGTTATATTTTCTGTTGGGGCTTGTAAACGCAGCAGTCACGCCTATTCTC
CTTCCATTTATAGTTATTTTCTTCAGCTTTTCTTATGTAGTATTCCGTCATCAGATCATAAATGTT
TACAACCAAGAGTATGAAAGTGGCGCCGTGTTCTGGCCTTCTGTCCATGGGCGTATTATTACTGCA
CTTGTAATCTCACAGCTGCTTATGATGGGACTGTTGAGTACAAAGCAAGCTTCCCAGTCAACACCA
TTTGCCATTGCTCTTCCTGAAGCAATGATGAAAGATACCCTGGAACGATCAAGTTCTCTGAACTTT
AATTTCAAATCCTACCTTCAGAATGCATATATCCATCCAGTTTTCAAAGGTGGTGATGATGATTGT
GCCGAGTATCTGAGCGAAAAGTTAGAAACTGATAGTGACAGTGTTTTAGTGCCTACAGTTCGCCAA
TCGCAAAGAAATACACCAGCAATAAGAAGTAGATCATCCTCACCGGCTTTATCCGATGAAGATAGA
ACAGTAGAGCCTGAAGTATGAAACTTACAAGCCAACATCTCCTTGCATGGCATATTGCAATGACAT
GAGACAGCTGGATTAGGCATTACCTTTGTGTATTT

SEQ ID NO: 495, protein - Populus trichocarpa
MNCNSHVLARGRGVSELVFLPKLAFFLVNHPDHYLSHQVVCNANNLASLVKKKESKQNWLDYYQNN
FDLNFYSSLLFQTGFLGLWGAKVDAIDHHVSEIEKLSKEIAEDREKILNDPNSIMPAAFVSFKTRW
GAAFCAQTQQSRNPTLWLTEWAPEPRDVYWENLAIPYVSLSVRRLIVGVSFFLAFLFLIPIAFVQS
LASIEGIEKNLPLLKPVIEIEFIKSVAQGFLPGIALKLFLTFLPTVLMMMSKLEGFMSLSSLERIS
AMRYYIFIIIDVFLGSILTGAVFEQLNSFINQIPETISVAIPMKATFFITYLMVDGWAGMAGEILM
LKPLIIYHLKNIFLVKTEKDRQEAMDAGSLGFNTSETRMQLYFLLGLVNAAVTPILLPFIVIFFSF
SYVVFRHQIINVYNQEYESGAVFWPSVHGRIITALVISQLLMGLLSTKQASQSTPFAIALPEAMM
KDTLERSSSLNFNFKSYLQNAYIHPVFKGGDDDCAEYLSEKLETDSDSVLVPTVRQSQRNTPAIRS
RSSSPALSDEDRTVEPEV FIGURE 24 (continued)

SEQ ID NO: 496, DNA - Populus trichocarpa
TTTGTTTTGGTTTTTTTGTTGAAGGTATCAATGGCAACGCTAGGAGATATAGCGGTTTCGGGGGCT
TTAAATCTACTGGGTGCTTTCATTTCTTATTGGCATTTGCAATCTTGAGGATACAACCTTTCAAT
GATAGGGTTTACTTTCCAAAATGGTATCTCAAGGGCTTAAGAAGCAGTGCCTCGCACTCGGGGCT
TTTGCTCGCAGGATTGTGAATTTAGACTTTAGATCGTATACCCGGTTTTTAAATTGGATGCCTGAA
GCGCTTAAAATGCCTGAGCCTGAGCTTATTGATCATGCAGGATTGGATTCAGCGGTTTACTTGCGA
ATTTACTTGATGGGACTTAAAATTTTTGTGCCTATAGCGTTCCTTGCTTGGGCTATCCTGGTGCCA
GTTAATTACACCAATGATACTCTAGAGAAAGCCCAGCTGGTGTCCAATGTAACTGCTAGTGACATT
GACAAGCTTTCAATTTCCAATGTTCCACTTAAATCACAAAGATTTTGGGCTCATATAGTGATGGCC
TATGCCTTTACTTTCTGGACATGCTACGTGTTGCTGAAGGAGTATGAGAAAATTGCTTCAATGAGG
TTGCAATTTCTTTCCTCAGAAGGACGCCGTCCAGATCAATTCACTGTCCTTGTTAGGAATGTACCT
CCGGATCCAGATGAATCTGTCAGTGAGCTTGTGGAGCACTTTTTCCTAGTGAATCATCCACATCAT
TATCTCATTCATCAGGTGGTGTGCAACGCAAACAAACTAGCCAGTTTGGTCAAGAAGAAGAAAGT
AAGCAGAACTGGCTTGACTACTACCAACTCAAGTATGACAGGAATCAATCACAGCGGCCTCTTAAG
AAAACTGGTTTCCTTGGGCTTTGGGGTGAAAAAGTGGATGCAATTGATCATCACATATCAGAGATT
AAGAAACTGTCAGAAGAAATAGAAGAGGAGAGGGAAAAGGTTTTAAAGGATCCAAAGTCTATAATG
CCGGCAGCATTTGTTTCATTTAAGACTCGATGGGGTGCAGCTGTTTGTGCACAAACTCAACAATCA
AGAAATCCGACTTTGTGGTTAACGGAGTGGGCTCCTGAGCCGCGTGATGTATATTGGGAAAACTTG
GCCATTCCATACATGTCACTCTCTGTTAGGAGGCTGATAATTGGAGTTGCATTCTTTTTCCTTACT
TTCTTTTTCATGATACCTATTGCATCTGTGCAAGCTCTAGCAAGCATTGAGGGAATCGAGAAAAAA
GCCCCTTTTCTGAAGCCCATTATTGAAATAAAATTTATCAAATCCGTTATCCAAGGTTTTCTACCT
GGCATTGCATTGAAGCTCTTCCTAATCTTCCTGCCAACAATTTTAATGATCATGTCTAAATTTGAA
GGCTTCCTATCTATATCATCTTTGGAAAGGAGATCAGCTACAAGATATTATATTTTCCTCATTATC
AATGTATTCCTTGGGAGCATACTCGCTGGGGCCGCATTTGAACAGCTAAATTCTTTTATCAATCAG
TCTGCTAATGAAATTCCTAAAACAATAGGTGTAGCTGTTCCATTGAAAGCAACTTTCTTCATAACC
TATATAATGGTTGATGGTTGGGCTGGAATAGCTGGAGAAGTTCTAATGCTGAAACCACTGATACTC
TACCACTTGAAAAATTTCTTTCTGGTGAAGACAGAAAAAGACAGGGAAGAGGCAATGGATCCTGGC
AGTCTTGGTTTTAACACCGGCGAACCCCGCATTCAATTATATTTTCTGCTAGGTCTTGTATATGCA
ACAGTGACACCTGTTCTCCTTCCATTCATAATTATTTTCTTTGCCTTCGCCTATGTAGTGTTCCGT
CATCAGATCATAAATGTTTACAACCAAGAGTATGAAAGTGGTGCGGCATTCTGGCCTGATGTCCAT
GGGCGTGTTATTACTGCATTAGTAATCTCACAGCTGGCTCTGCTGGGACTGATGAGTACAAAAGAA
GCTGCGCAGTCAGCACCATTTCTCATTGCTCTTCCTGTACTCACTATATGGTTCCATGGGTCTGC
AACGGACGCCACAAATCTGCTTTTGTCAAATATCCATTACAGCTTGATCTTTTTGTCATGAAGCAT
GAAATGCCTAGCTGTGTTGATGACATTGTTTGTTTACTGTTGTGAAAAGCTTGATTTGATGATAAT
GGAGGAAGAGAAAGAGGAAAAATTCAACCACTTTCTTTTCAAATGAAAAATTTTTTAGT

SEQ ID NO: 497, protein - Populus trichocarpa
MATLGDIAVSGALNLLGAFIFLLAFAILRIQPFNDRVYFPKWYLKGLRSSASHSGAFARRIVNLDF
RSYTRFLNWMPEALKMPEPELIDHAGLDSAVYLRIYLMGLKIFVPIAFLAWAILVPVNYTNDTLEK
AQLVSNVTASDIDKLSISNVPLKSQRFWAHIVMAYAFTFWTCYVLLKEYEKIASMRLQFLSSEGRR
PDQFTVLVRNVPPDPDESVSELVEHFFLVNHPHHYLIHQVVCNANKLASLVKKKKSKQNWLDYYQL
KYDRNQSQRPLKKTGFLGLWGEKVDAIDHHISEIKKLSEEIEEEREKVLKDPKSIMPAAFVSFKTR
WGAAVCAQTQQSRNPTLWLTEWAPEPRDVYWENLAIPYMSLSVRRLIIGVAFFFLTFFFMIPIASV
QALASIEGIEKKAPFLKPIIEIKFIKSVIQGFLPGIALKLFLIFLPTILMIMSKFEGFLSISSLER
RSATRYYIFLIINVFLGSILAGAAFEQLNSFINQSANEIPKTIGVAVPLKATFFITYIMVDGWAGI
AGEVLMLKPLILYHLKNFFLVKTEKDREEAMDPGSLGFNTGEPRIQLYFLLGLVYATVTPVLLPFI
IIFFAFAYVVFRHQIINVYNQEYESGAAFWPDVHGRVITALVISQLALLGLMSTKEAAQSAPFLIA
LPVLTIWFHGFCNGRHKSAFVKYPLQLDLFVMKHEMPSCVDDIVCLLL

FIGURE 24 (continued)

SEQ ID NO: 498, DNA - Populus trichocarpa
ATTGTTTCTTTCAAGTGAAGTGAACAGGATATGGCGACAATAAGTGATATAGGAGTAGCAGCAGCT
ATTAATATACTCACTGCATTTGCTTTCTTTATTGTGTTTGCGATTCTTCGGATTCAGCCGGTAAAT
GATAGGGTTTACTTCCCCAAATGGTATATCAAGGGTTTAAGGAGCAGTCCATTGGGCACTGGTGCG
TTTGTAGGCAAGTTTGTCAATTTGGACTTCAGGTCATATGTGAGGTTTCTCAACTGGATGCCCGCA
GCATTGCAAATGCCGGAGCCTGAGCTAATTGACCATGCTGGATTGGACTCTGCTGTGTACTTGAGG
ATTTACTTGACAGGGCTTAAAATTTTTGTTCCTATTGCATTCCTGGCCTTCACTATCTCAGTGCCA
GTTAATTGGACAAATAACACTCTGGAGCATTCTACTTTAACTTACAGTGATTTGGATAAGCTCTCT
ATATCAAATATACCCACAGGATCATGCAGACTGAATTTGTTATCTTATGTTTGCTTTTTTATGAAA
AAAATACCAATTAAAGTGGAGGGTTTCTTCAAACAACAAGGGGTTGGGTCAACTATTCAATCAAAT
GATATTGAGTATGTTTCCATCTCTTCTCAAGAAAGAAGTGGGCTATTTCTTTGTAAAATTGTGCTC
AATTTCATATGTGGCAATTCCGGCAAGAACTCTTCGTTAGTTGGGGAAATAATCCGCAGCCTTTGA
TTCTGGACCCATATGGTGATGGCTTATGCTTTTACCTTCTGGACATGCTATGTGCTAAAAACAGAG
TATGAGACAGTGGCTAAAATGAGGTTGCATTTTCTTGCATCAGAGAAACGACGTCCTGATCAATTT
ACAGTACTGGTTAGAAATGTGCCACCAGATCCTGATGAATCAGTTAGTGAACTTGTGGAACATTTT
TTCCTGGTTAACCATCCTAGCGATTATCTCACTCATCAGGTTGTCTACAATGCTAATGAACTTTCT
AACTTAGTCAACAAGAAGAAAAAGATGAAGAACTGGCTTGACTACTATCAAATCAAATATTCAAGA
AATCAATCCAGAAAGCCTTCTCTCAAGACTGGTTTCCTTGGCCTTTGGGGGAATAGGGTGGATGCA
ATTGATCACTACACATCTGAGATTGAGAGACTATCAAGAGAAATCTCCTTGGAGAGAGACAAGATT
GTGAACAATCCCAAGTCAATCATGCCAGCAGCATTTGTTTCCTTCAAAACTCGATGGGGAGCCGCT
GTTTGTGCACAAACACAACAATCCAGAAATCCAACTATATGGTTGACTGGGTGGGCTCCAGAACCC
CGTGATGTATATTGGGATAACCTCGCAATTCCATTTGTTTCGCTCACACTAAGAAGGCTTGTTATT
GCTGTTGCGTTTTCTTCCTCACCTTCTTTTTCATGATTCCCATTGCATTTGTACAGTCCCTTGCG
AACATTGAAGGAATTGAGAAAGCACTCCCATTCCTGAAACCTATAATTGAAATGAAAGTGATTAAG
TCATTCATTCAAGGTTTCCTTCCTGGAATAGCTTTGAAGATATTTCTTATTTTTCTACCCTCAATA
TTGATGCTAATGTCTAAATTCGAGGGATTCATTAGTCTATCAGGCTTAGAGAGGAGATCTGCAGCT
AGATATTATATCTTCCAATTCGTTAATGTGTTTCTTGGAAGCATAATCACCGGAACTGCATTTCAA
CAACTGGATAATTTTATCCACCAGTCTGCAACTCAAATACCAAAGACAGTTGGAGTTTCGATTCCT
ATGAAGGCAACTTTCTTCATAACTTACATAATGGTTGATGGGTGGGCTGGAGTCGCTGGGGAGATT
TTAAGATTGAAACCCTTGATAATCTATCACCTGAAAAACTTTTTCTTGGTGAAGACTGAAAAGGAT
AAGAAAGAGGCGATGGATCCAGGAACTCTTGGTTTCAACACAGGGGAACCACAAATACAACTTTAT
TTCCTACTTGGCCTCGTCTATGCAGTGGTGTCGCCTATCTTACTTCCTTTCATAATTGTATTCTTT
GCCCTCGCATTTGTTGTATATCGTCATCAGATTATAAATGTTTACAATCAGGAGTATGAGAGTGCT
GCAGCATTCTGGCCTGATGTTCATGGACGCATCATAGTTGCAGTAATTGTCTCACAACTGCTGCTA
ATGGGATTGTTAAGCACAAAAGAAGCTGCTCAGTCCACACCGTTGCTCATTACACTCCCAATATTG
ACAATATGGTTCCATTTGTTCTGCAAAGGCCGATATGAACCTGCTTTTGTTAGATATCCATTGCAG
GAAGCAATGATGAAAGATACATTGGAACGTGCCAGAGAGCCAAACCTGAACCTGAAAAGCTTCCTT
CAAAATGCTTATAGCCACCCAGTTTTTAAAGGCGAAGATGATAGCGACAGTGATGAAGCACCCGAA
GAGTTTGAGAAAGAACCTGATCTGGTCCCAACAAAGCGCCAGTCTCGAAGGAATACGCCATTGCCA
AGTAAACATAGTGGTTCAGTTCCATCCTCCCAGCGTGAAGCTCAGGATTATCCTCTACTCTGAAAC
TGTTTCTGCGACATCAACTTGTGTGTAAATGCGAGTCCTTGGGAGATTAAACTGGTTGATATTTCT
TCAGCACAGAG

SEQ ID NO: 499, protein - Populus trichocarpa
MATISDIGVAAAINILTAFAFFIVFAILRIQPVNDRVYFPKWYIKGLRSSPLGTGAFVGKFVNLDF
RSYVRFLNWMPAALQMPEPELIDHAGLDSAVYLRIYLTGLKIFVPIAFLAFTISVPVNWTNNTLEH
STLTYSDLDKLSISNIPTGSCRLNLLSYVCFFMKKIPIKVEGFFKQQGVGSTIQSNDIEYVSISSQ
ERSGLFLCKIVLNFICGNSGKNSSLVGEIIRSLXFWTHMVMAYAFTFWTCYVLKTEYETVAKMRLH FIGURE 24 (continued)

FLASEKRRPDQFTVLVRNVPPDPDESVSELVEHFFLVNHPSDYLTHQVVYNANELSNLVNKKKKMK
NWLDYYQIKYSRNQSRKPSLKTGFLGLWGNRVDAIDHYTSEIERLSREISLERDKIVNNPKSIMPA
AFVSFKTRWGAAVCAQTQQSRNPTIWLTGWAPEPRDVYWDNLAIPFVSLTLRRLVIAVAFFFLTFF
FMIPIAFVQSLANIEGIEKALPFLKPIIEMKVIKSFIQGFLPGIALKIFLIFLPSILMLMSKFEGF
ISLSGLERRSAARYYIFQFVNVFLGSIITGTAFQQLDNFIHQSATQIPKTVGVSIPMKATFFITYI
MVDGWAGVAGEILRLKPLIIYHLKNFFLVKTEKDKKEAMDPGTLGFNTGEPQIQLYFLLGLVYAVV
SPILLPFIIVFFALAFVVYRHQIINVYNQEYESAAAFWPDVHGRIIVAVIVSQLLLMGLLSTKEAA
QSTPLLITLPILTIWFHLFCKGRYEPAFVRYPLQEAMMKDTLERAREPNLNLKSFLQNAYSHPVFK
GEDDSDSDEAPEEFEKEPDLVPTKRQSRRNTPLPSKHSGSVPSSQREAQDYPLL

SEQ ID NO: 500, DNA - Triticum aestivum
GCACGAGGCTGAGAGCAGCGGCAAGATCAACATCAGACGTTAAACCAGAGGAGTTTGCAATGTTGG
TGAGAGATGTTCCTGTTCCACCTCCTAATCAAACTATAAAGGACTCGGTGGACTCGTATTTCCGAG
CACTTCATCCTGACACATTCTACAAAGCAATGGTTGTGACAGACATCACGAAGGCTGATAAAATTT
TCCAAGAGATTGAAGGTCACAAACACAAAATTGCTCATGCTGAAGCTGTCTATGCAGAATCAAAAA
CAGCAAACAGACCTGAGGGCACGAGGCCTACTCATAGGACAGGATTCCTTGGCCTTATCGGTAAAA
AGGTCGACACGCTTGAGTACTGTAATGAGAAGATTAAGGAATTGCTGCCCAAACTGGAGGATGAAC
AGAAGAGCACCCTTAGTGAGAAACAGCAAAGGGCGGCCTTTGTCTTCTTCAACAGCAGAGCTGCCG
CTGCCTCTGCATCTCAGACTCTCCATGCTCAGATGTTTGATGAATGGACAGTTACAGAAGCTCCTG
AACCACGTGCTGTAATATGGACCAATCTTCCAAGGAAAATATATGATAGGCAAACCAGACAGACTG
TGGTCTACCTCATTGTCTTCGTCACCGTGGTTTTTTATATGATTCCCATTACTGCTATCTCTGCTG
TTACAACGCTGGAACAACTGAGGAAGAAGCTGCCCTTTCTGAAGGTGGTTGTGGACCAACCTTTAC
TTAAGACAGTCTTACAAGCTTACCTGCCACAGATCGCCCTCATTGTTTTCCTTGCTTTGCTGCCAA
CACTTCTTGTGTTCCTGTCAAAGTCAGAAGGAATTCCTTCACAGAGCCATGTAGTAAGGGCATCAT
CAGGAAAATATTTCTACTTTATTGTCTTCAATGTATTCATTGGCTATGCAATTGGTTCCTCATTGT
TCAGCGCTTTGCAAAAAGTCATCGAGAACCCTACTGGGATTGTTACGACGCTTGGCTCCAGGCTTC
CTGGAAATGCAACTTTCTTCCTCACATTTGTTGCACTGAAATTCTTTGTTGGATATGGGCTTGAGC
TCTCTCGTTTGGTCCCCCTCATCATTTTCCACCTGAAAAGAAAGTACCTATGCAAGACAGAGGATG
AGGTGAGAGCGGCATGGGCTCCAGGAGACCTGGGGTATAACACGCGGGTTCCGAATGACTTGCTTA
TCGTGACACTTGTGATGTGCTACTCCGTCATCGCGCCTTTGATTTGCCATTTGGCGTTGCTTACT
TTGCTCTGGGTTGGCTTATAGCAAAAAACCAGGTTCTGAGAGTTTATGTTCCTATTTATGAGAGCA
ACGGACGAATGTGGCCACACATGCACACAAGGATCATTGCAGCTCTCATGATTTACCAGGCAACCA
TGCTTGGTATCATCGGCCTGAAGAGGTTCTACTATTCTACTATCCTTGCCCCACTCCTCGCAATAA
GCTTAATCTTTGCCTACACTTGCCATACACGCTTTTATCCTGCATTCGCCAAAACCCCTCTTGAGG
TGGCAAGTCAGCAGCTGAAAGAGACGCCGAACATGAGCACCATTTACACCGCTTACATCCCTGCTT
GCCTCAAGCCCGAGAAGCTCGAAGATGTGGAAGTCTTTGAAGACGCGCAGTCACGCACCACCTCCA
GAGCTCCCTCTTTTTAATGATTTGTGATGAATGTCCACGTGCTCTGGACGGCCTTTCCACGTCGAC
CACGCTGTGAAGCTATTGTTTCCAGGATAGGAAACTGATGTCATGTCCCGTGTACATACATGCGCT
GTTGCATGATGAACACTTGTTGAAAAACGTAGTCTTATATGTTAGGTTGTTGCTGTGGATATTGTT
GGGTGTTTACGTTTTTCTTTTTGCTATTATCGTGTGTAGACAATCTGCTGCCCTGGTGTGTAAAAA
TCTCAGAAGTCTGACTGCTTGATGCCTTTTAACCCTGTTAGCAAATTATCCCGGTACTGTTACTAT
TTGTTACTGAGATGTCCATGCTG

SEQ ID NO: 501, protein - Triticum aestivum
MLVRDVPVPPPNQTIKDSVDSYFRALHPDTFYKAMVVTDITKADKIFQEIEGHKHKIAHAEAVYAE
SKTANRPEGTRPTHRTGFLGLIGKKVDTLEYCNEKIKELLPKLEDEQKSTLSEKQQRAAFVFFNSR
AAAASASQTLHAQMFDEWTVTEAPEPRAVIWTNLPRKIYDRQTRQTVVYLIVFVTVVFYMIPITAI
SAVTTLEQLRKKLPFLKVVVDQPLLKTVLQAYLPQIALIVFLALLPTLLVFLSKSEGIPSQSHVVR

FIGURE 24 (continued)

ASSGKYFYFIVFNVFIGYAIGSSLFSALQKVIENPTGIVTTLGSRLPGNATFFLTFVALKFFVGYG
LELSRLVPLIIFHLKRKYLCKTEDEVRAAWAPGDLGYNTRVPNDLLIVTLVMCYSVIAPLILPFGV
AYFALGWLIAKNQVLRVYVPIYESNGRMWPHMHTRIIAALMIYQATMLGIIGLKRFYYSTILAPLL
AISLIFAYTCHTRFYPAFAKTPLEVASQQLKETPNMSTIYTAYIPACLKPEKLEDVEVFEDAQSRT
TSRAPSF

SEQ ID NO: 502, DNA - Volvox carteri
GTCCCCCTCAACAGTTACAATTTAAAATGTTGTTTACTTTTCTGAATCTCAAAATGCATAGGTGTA
GCACACATGCTGGTGGCTAATGCAAGCCAGTGTTTGAATATCCTCTTGGTCGCAATAGCGAAGATT
AAGGACATGTCAGACAAGAGCGTTGTGAACACTGCGTTGGGCAGGATTATCGGGGTGAAGAACCAG
GTGTCGGATACGACCATTATAACCGGTTTATGGATCTCAGGCGTAGTCGGCACTGCAGTCATCATA
CTCTTTTGCGTGCTTCAACGCGTGAGCCTGCTGTACAAGTACCGGTTGGTTGCCAACCATGTACGG
GTCAAGCCCCCAAAGCTGCGGGAGCGCGGTCTCATCTCCTTCATTGATTGGGCCATCAAGTCGATA
TCGGTGTCGGATGTGGACTTCATTCTCTCGGCCGGACTAGATGCGCTGATCATGGTGAAGATCTGT
GCGCTAGGTGTGCAGCTGTTTCTACCCCTATGCATTCTGGGAACCGCAGTCCTCATCCCGTTGCAC
TGGACTGGGGGCGCCTCCAAACAGCTGGACGCTTACCAGAGCGGATTCATGCGCCTCACAATGTCC
AATATCCCGCATGGCTCCAAGGTCTTTTGGGTGCATCTGGGTTTTGTCTACATCTACCTGGGATGG
GCTATGGTGCTGCTACACTGGCATTACCACCAGTACCTCACCATTCGCCAGCACTACCTGCGGAAA
GGTGATGACGTAAATCTGTGGCGGGCTCTGTACGAAGAGCAAGGACGGCCGGATCCGCCACAGGGC
AAGGAACCTAGGGGCTCGGAATTCATCAACGGCCTCTTGCGCAGCGTGCAGCTGATCAAGGCACTC
ATGCCGTCGGGCGTGCCTGTCAGCGGGCCCACGTCCCTGCCTGCAGACGGCCGGGACGAGGAGGAT
GAAGATGAGGAAGAGGACGAGGGCTTTGCGATGGGTGGCATGCCATTGCCGTTGGAGTTGAGGAGG
ACGACCCTGGGAGGCCTGGACCCAGTTGGGGCCCGGTCGCCGAGGGGCTCTGTGGACGGGTGCGGA
CGCGTGGTACACGTGCGAGGACATGGGGATCTTTGGGCGGGGGAGTGGAGCCAAAGCCGCGTACTG
CAGCTCTCGGGGCGCATGACGCACCGACGGCCGGGTCGGGGACCTCATCAAGGCTGTCCCGCCGG
ACTCTGGCCCAAGCAATCCGCAACCGCGTTACCGGCTCTGGAAGCACCGTGTTGCGGGCCTCGGGG
GCACAAGACCATGGCAGCAGACTCATCCACCGGGCCGCCTACAGCATCGGACCCCGCGCGGTGGCG
GCCCCTAGCGACCAGGCGCTGCAGCACATGCGACCACAGCTCAGCCTTGACCGCGGAGGCAGGCGG
GGCATGTCGCCGGCCCGAGGGCAGTCCTACTTGAAGTCAAGCGAGCCGGTCAGCCTTCAGCTGAAG
GAAAGCAGTGACGCCGCTGCCGGCTGCGGCCTCGGTCAGGAGGGGCTACTGATCTGGAGGCGGGG
CTGGGCCGCAGCGTTCTGGGTGCGGACTCGCGCTCTTTGGCCCCAAGCCCTTGCTCCATAGATCGC
AAAGGGTCGGGTCTAGACTCTGATGCGCACCTGCTTGAGTGGTGGCTGGAGCGTCCGGAAGCGACC
GTCCAGTCGCGCTCACGTGCGCTGCGGGCGCAGCTGGAGAAGGCGCTGAACGGGCGCGACATGGAC
TTGAAACGGCCCAGCGTGGGCCACCGCAAGACGGTGAATGCGGAGTTCTCGGACGGCACGCGCGTG
GCGGTGCTGGCGCAGCACTACGCGGTGCTGGTGACGGACGTTACATCGCGCAGACCGCGACTGAGC
AGGCGGAACAGCAGGGGCCCCGCTCAGCCTACGTTGGTAACGCTGCCTGGCAGCGAGGCCGCTGAC
GCCGTCACTGAAGTGCAGGTTACCGGTCGTCGTCCAGCTGGATGCTGCCTACCTCCATGGCTTTGG
AGCTGGTGTGACCTACAGTACGGTCACCAAGCCGCCCGCAAGCTCAACCCCAAGCTTCCGGCTACT
CTGTCTGAGGAGCTCCTCGCGCCGGTCCCCAGCGGTGCCAACCGCACCATTGCGAGCATGACGGCG
CTCGCCCGTGGGTCCACTCCATACCACTGCTCCCCCGGGGCTCGGGGGATGGCCGTGTCGTGCCA
GCTCTGCTGAGTGGTAACCGCACATGCAGCGTCAATACGCCCTCGCATGCGCAGCCTCTCTCTGCG
CTACAGACCACCTCAACCGCGGGTCGTATCGACCTGAATCCCGACTCATCACCGAAGATGGCCGGT
CGGTGGCACCAGGCAGTGCGCGGTGCAGCGTTGCTGGGCCGGGCCCCGCAGGGGGCACTTGGAGC
GGCAGTGGCAGTGGCAGCGGCAGCGAGAGACTGATTCGGCTGCTGGAGATGATGGCCCGGGAGGCG
CAGGGAAAGCTCGCGGCAATGAGCACAGGGATCGTATCGGCCAACCCGTCATTGAGTCGCGGCAGT
CCCAGCAGTCATCACACCGGCACCGGCTCTGGCACTGGTACGAGCCACCCGGTGCCGACGTCGTCT
GTCAGGGCTGTGGCTCTGCCCAGGTCCTTTGGTACTGGCCCCTCATCATCACACCAGCAGCTACAG
CACCAGGGGGTGCCGCATCGGTTCACGGAGCCAGGTCCCGCAGCAGCAGCTGCTAGTGGCGGACAG

```
GCCGCGGCGCGCAGAGGACAGGCAGCAAGCCCGAGGGCAGGTAGCGGCCCCATCATCATCTCTCCA
AGGGTACCGGTAGGCGCATCGCTTCGCGGGGTGGCGGCACTGGGACAGCGGGAGGGCCCAAGCACC
AGCGGCACAGGCGCCGGTCCGGTGGCAGAGGCGTCGTTGGAGATTCGTGAAGAGGGCCAAGCCGGG
GACGCTGCCGGGAGTGAGGGCGTCATCCAGGAGGGTAACCACGTCGCCGGCAGCGCAGGTGCCTCG
GCGGCCGCTGGCGTGGGTGCCGGTGCGGGGCAGGATGGCGGGCGAACGGTAGTAGATGCAGCGACG
TCGCAGCGTCAGGAAGGCTCACCACCAGGGGACGAGGTGGAAGCCAATCCGGTATCCCAGCAGCCA
ACCGAACGCGAACGCCTGCGCGCCGCTGCGCTTGCCGGATGGGAGGTTGTACGGCAGGCGGTGTGG
GACGGCCGCGTGGCGGAGCTGCCGTGGCGGTACCGTTACTCGGTGGTTTCCGCCACCTTCCTGCGG
CTGTTCCCCGAGGAGTTTGACCGCGCCATCCAGGTCGTCAATTTCAAGGAGGTGGACCTGCTGCTG
ATGGAAGTGGACAAGCACATGGCGCAATACGAGTATGCCATCAAGTACGAGGAAAAGACCGGGAAG
CCGCTGTACGGGTGTCTTGGGTTTTGCGGGCTGGTGGGGAGCGGTGCAGGGTGCGCGACCACCAC
CGCGACAAGATCAACGACCTCCTGGTGCAGGTTCGGAAGGCGCGAGTGGCGGCTGCCAACAAGGCG
CACACGCCGTCCTGGTTTGTGTTTTCCGCACCCAGCGCGCCGCCGCCATGGCGTCTCAGTGCATC
ATCCACGCGGAGGACAACCGGCAGTTCCGGGTGCACCCCGCTCCCGGCCCTGACGAGGTCAACTGG
TCGGCCCTCTGGTCCAACTTCCGCGACCGCGACCTGCGGCGCAACCTGATGCGCCCGCTGGTGGTG
CTCATGGTCGCCTTCCCCATCGGCATATTCACCGGGGGTGTTACTCAGCTGGACTACCTGCTGTGT
CCGGCACACCTCTGCGTGGGGTTAGAGAGCGGCTCCGAAGACTGGGTTGCGGCGGGCTGCACGGAC
GACATCAAGGAGCGGGAGAGCGCGGATATCAAGACAAGGTGCACATTGGCTGGGAAAACGCTGTTT
GGTGTGGCGCATGCGCCGAGCCAGCAGCTGTCCTGGGAGTGGTACTGCGGACAGAAGAACCCAATT
GCGAGGCTGCTCAAGCGGCTGGTGGTGGCCTGGCTGCCCTCCCTGCTGCTCATCCTGTGGCAGGGC
ATGGTGCTGCCGCTGTTCTTCACATTCGTGGTGCAGATCAGTCGCCAGGCCCGGTCTCTATCGGAG
GCCGACCGCTACATCGCCAAGAACATGTTTTATTTCGGTGTCTTCAACGTTTTCCTGGGCGGGGTG
GCGGGCAGCACCATCATTCAGGGTATCAACTCGGCCATTGAGAAGGGCCCAAGTGAAATCTTCAAT
TTGGTCGGCACATACGTGCCCACCTCGTCCAACTTCTTCATCAACTACACCATGTTTAGGGTTTTT
GTGTCCGTCCCGGTGCGCATGCTGTGGCCCCACATCGGAATCCGCATGTACCTCATCCGGCGGTAC
CTGCGGCTCTCGTGCATCATCACGCGTCGCGAAAGGGCCTTCCTCATGGCTCCGGTGTCGCCGCGA
TATGGGTTCGAGGTGGGCATGGTGATGATAATCTTCCTGATTGCCTTCGCCTTTAGCGTGGTGTCC
CCGCTTCTGATGCCCATGGCGATGCTCTTCTTCGCCATCTCCTGGCTCTTCTGGCGCTGGGCGCTG
CTCTACGTCTACGTACGCAAGTACGAGGGTGGCGGCACCATGTGGCCTTTCGTCTTCAACCGGGTG
CTGGTCTGCCTGGCCATCTTCCCCGCCTTCACGGCATGCGTCTTCGTCACGAAGCACGCGTATGCA
CAGGCTATTGTGCTGCTGGTTACCGTCCCTGTCATCCTGGTCCGCTTTCACAAGTACTGCTACTAC
AGGTTCGAGACGGGTCTCCAGGCAATGCCGCTGGAGGCCACGGTGGCGGCCCCACCCGCTCGCGTG
GAGCCCTGGGTGTACACGCCGCCGCCGTTGCTCAGCAACCTGGCCGGGTGGCACCCCGACTGGTCC
AAGTGCTGGATGGGCTGGAACATGCCCGTCATGTACGGGTAA
```

SEQ ID NO: 503, protein - Volvox carteri
MLVANASQCLNILLVAIAKIKDMSDKSVVNTALGRIIGVKNQVSDTTIITGLWISGVVGTAVIILF
CVLQRVSLLYKYRLVANHVRVKPPKLRERGLISFIDWAIKSISVSDVDFILSAGLDALIMVKICAL
GVQLFLPLCILGTAVLIPLHWTGGASKQLDAYQSGFMRLTMSNIPHGSKVFWVHLGFVYIYLGWAM
VLLHWHYHQYLTIRQHYLRKGDDVNLWRALYEEQGRPDPPQGKEPRGSEFINGLLRSVQLIKALMP
SGVPVSGPTSLPADGRDEEDEDEEEDEGFAMGGMPLPLELRRTTLGGLDPVGARSPRGSVDGCGRV
VHVRGHGDLWAGEWSQSRVLQLSGAHDAPTAGSGTSSRLSRRTLAQAIRNRVTGSGSTVLRASGAQ
DHGSRLIHRAAYSIGPRAVAAPSDQALQHMRPQLSLDRGGRRGMSPARGQSYLKSSEPVSLQLKES
SDAAAGCGLGQEGATDLEAGLGRSVLGADSRSLAPSPCSIDRKGSGLDSDAHLLEWWLERPEATVQ
SRSRALRAQLEKALNGRDMDLKRPSVGHRKTVNAEFSDGTRVAVLAQHYAVLVTDVTSRRPRLSRR
NSRGPAQPTLVTLPGSEAADAVTEVQVTGRRPAGCCLPPWLWSWCDLQYGHQAARKLNPKLPATLS
EELLAPVPSGANRTIASMTALARGSTPYHCSPRGSGDGRVVPALLSGNRTCSVNTPSHAQPLSALQ
TTSTAGRIDLNPDSSPKMAGRWHQAVRGAALLGRAPQGGTWSGSGSGSGSERLIRLLEMMAREAQG

FIGURE 24 (continued)

KLAAMSTGIVSANPSLSRGSPSSHHTGTGSGTGTSHPVPTSSVRAVALPRSFGTGPSSSHQQLQHQ
GVPHRFTEPGPAAAAASGGQAAARRGQAASPRAGSGPIIISPRVPVGASLRGVAALGQREGPSTSG
TGAGPVAEASLEIREEGQAGDAAGSEGVIQEGNHVAGSAGASAAAGVGAGAGQDGGRTVVDAATSQ
RQEGSPPGDEVEANPVSQQPTERERLRAAALAGWEVVRQAVWDGRVAELPWRYRYSVVSATFLRLF
PEEFDRAIQVVNFKEVDLLLMEVDKHMAQYEYAIKYEEKTGKPLYGCLGFCGLVGERCRVRDHHRD
KINDLLVQVRKARVAAANKAHTPSWFVFFRTQRAAAMASQCIIHAEDNRQFRVHPAPGPDEVNWSA
LWSNFRDRDLRRNLMRPLVVLMVAFPIGIFTGGVTQLDYLLCPAHLCVGLESGSEDWVAAGCTDDI
KERESADIKTRCTLAGKTLFGVAHAPSQQLSWEWYCGQKNPIARLLKRLVVAWLPSLLLILWQGMV
LPLFFTFVVQISRQARSLSEADRYIAKNMFYFGVFNVFLGGVAGSTIIQGINSAIEKGPSEIFNLV
GTYVPTSSNFFINYTMFRVFVSVPVRMLWPHIGIRMYLIRRYLRLSCIITRRERAFLMAPVSPRYG
FEVGMVMIIFLIAFAFSVVSPLLMPMAMLFFAISWLFWRWALLYVYVRKYEGGGTMWPFVFNRVLV
CLAIFPAFTACVFVTKHAYAQAIVLLVTVPVILVRFHKYCYYRFETGLQAMPLEATVAAPPARVEP
WVYTPPPLLSNLAGWHPDWSKCWMGWNMPVMYG

SEQ ID NO: 504, DNA - Volvox carteri
ATGTGCAGATATGCTAAGGACATCGACCTTAAGCCCAAGCGGCTACCAAATGGGCTGCTTAGCTGG
ATCTACCCCGTCATTACATATCCTGAGGGGGATATTATCGACGAGGCTGGGCTGGACTGTGCGATG
TATCTGCGCATTCTCCGTTTCGGGGTGTACCTATTCTTCCCCCTCACGATCTTTTGCATCATCGTG
GTGCTCCCGCCCAACATGAAGAGTAACGGAATTGAGGCAATCCTCGCGGAGCAGGCTTTGCGAAAT
GCCGGCAAGAACCAGACCTCGGGCAAAGGCGACTTGGAGTTCTCCGATTTCGACCATTACTCGCTG
TCCAACGTCGAGGCCGCCAGTCCCAAGATGTGGGCACACCTGTTCGCTGTGTACTGTGTGGTGCTG
TACACCCTCTGGCTGCTGTGGCGGTTCAACCGCGAGTCCGTGTTGCTGCGGCTACTCTTCCTGGGT
AATGCGAAACGCGGAGGGCCCTCTCACACCGTGTTGGTGACGGATATTCCGGGTATTAGTGAGGCT
GTTTCCAAGGCCCTACGGGACGAGCGGGCGAAGAAGCAGGAGATGAAGAAGATGGAACGAGATAAA
TCTATTATCTCGCAGAAGAGTGTGGACGTGCAGCTGGACGACGACAGCTACGCAGAGCTCCCCGAC
CAGCCGCGGACCGCCACCACCAGCGTCGCCAGCACCACGCTGAAGCCCCAGACCTCACTGCGCAAG
GGCCGGGTGGTCTCCATCAGCGAACCCCCGGTGCTTGTAGTCCAACAACAACAGCTGCAACAACAG
CAGCAGCAGTTCACGCCGCGTGCCGTGCCGTCGGTGGAGAAGGGCGGCCGGTCGAACGTATCAGCA
TCGCCCTTCTCCGACGCCAGCGCCAAGAGCTTTGAGAGTACTGCAGACGCCGAGCTGCCAGGATCC
TCCACGAAACCCGAGGTTGTCGAATTAAAGAGCGCCGCCTCGGCCTCTGGCGGCGCCGCTGCTGGC
GGCGGCCCCGCCGGTCCCGCCGGGGGAGCTTCCTTTGTTGTTAAGGCCGGCGGGAACAGTCGCTTT
AACTTGCGCAGTATCCTGAGTAGCACCGCTAGCGACGCGCAATACCGGCTGGTGGTGGATGACCTG
GACCCCAAGTACGCGGCCACGGGCGGCAAGTTGGAGTTGGCGCGCGTTGGCAAGACGAACGAGGAG
ATCCTTAAGGAGTTGCAGGTCATGGAGAAGGACGATTTGGTCAAGGGCCTTCCCGAGAAGCTGGGG
GTGGATACGAGGCCGCTGCCTCCCACCCGCCGCAACACCAAGCGTTATGAGTACGACCTGAAAACA
ACGGTGCTGGATCCCGTACATGAGGCCCTGGAGACATTGAGGAAAGGCGTGACTCCACAGCAATTG
GTGGCCCGAGAGTTTGCGTTGGTGTACGGCACGAGCAATGTGGCCGCGGTCAACATGATTCAGGAC
ACGAGCGCGTTGGAGCCTCTGGCTGAGGAATACAACCAGGCGCGTGTGTCAGGACCTGGACGAC
TACCTGGAAATGGCCAAACTGCGACTCAAGCTGCGGAAGGCGCTGCCGCAGAAGCAGATCTCCATC
CTATGTGCTCGGTACCAGGACATGGACTATGTGAAGAAGTTTAAGACGAAGTGGTTTGTCAAGGTG
GACGCCGTGGAGTTCTGGTTGGAGCGCATGAAGTACCTCCGGGAGCGTATTAAAATTGAGCAAGCC
AAGTGTGTCCGCAAGATGGCGCCCTCCGCCTTCGTCACCTTCAACACTCGCATGGCTCAGGCTGTC
AGCGCCAACTCGCTACACTCCCACGACGAAAACGCCTGGCGGGTACAGAACGCCCCTGCGCCGTTT
GAGGTGGTGTGGAAGAACCTGTCGCTAACAATGCCCATCAAGAACGGCCGGCTGTACCTCCTGTGG
GCTGCTTTCTGGGGCATGACCATCTTCTTCATGGTGCCTGTGTCCTTCATTCAGGGCATGATTGAG
GTTCCCAAGCTGGCCTCCATTCCCGTGCTGGGCGACATCGTGACCACCCCGCCCATCAAGCAGCTG
CTGCAGGCTGTCATTCCAGGTCTGGTGCTCAAGATCTTCCTGGCGCTTGTACCCACCATCCTGCGC
ATCATGGCGCAGCTGTCCGGCGCCACCTCCGTCAGCGAGATCGACTTTGGAGTCGTGAAGCGCTTC

```
TTCCTGTTCCAGACGGTGGTGGTATTCTTCGGGAGCATCATTCTCGGCTCCTTTTTCAACCAGCTG
AAGCAGTGGGTGAAGGAACCCAGCAGCGTCATCGCCACACTGGGCAAGTCCATCCCCATGACCTCC
ACGTTCTTCATCACTTATCTTCTCGTGAACGGTCTGGGTGTCAAGTCGTTTGCCTTCATTCGGCTG
CCCAACTTTGTTATATATTGGATCTTGTCCAAGTTCGCGGGTAGCCCCGCGGCCCGGCAGCGCATG
TGGATGTTCCAATGGACCAATAACGGCACCACGGTGGTGGATCACACCATCGCCATGATGCTGGGA
CTGACCTTCTCCTGCATCAACCCCATCGTGTGCCCCGCTGCGCTGGCGTACTTCTTGGTCAATTTC
CTAGGGGAAACGTACAACAACGTGTACGTGTACCGCCGCCAGTACGAGAGTGGCGGCATGCTGTGG
AAGACGGTTTACAACCAGGTGATGGTGGCGCTGTACATCATGCAGATCACCATGCTGGGCCTGCTG
TCCCTCAAGAAGTTCAAATTCAGCCCTTTCATGTTTCCCCTCATCATCTTTTCCATCACCTCGCAC
ATCAGCACACTGCAGCTCTTCAACAGGCCCTGGTCGGTGACGGCGCTCCACGACGCCGCTTACATG
GACATGTTGGAGGCGGACCAGCGGCGGATGACACTGCTGGCAGCTGCACGCGAGGAACGCAAGAAG
AAGCGCGACAAGATTAAGAGGGCGTACGACGATGCCGTACGCCAAGCCGAGAACAACGACGACCCG
CCGCCACCGTACGACACCAGGCTGGACGAGGTTCCGTCGCCCGGCTACCCCGGCGCGGGTAAGGCC
GAACTTCTGCTGCTGGAATCCATCGAGGGAGATGGCTACGCACTTAACTCCCAGGAGAAGCGTGAA
GTGGAGGAGATGTACATGAACCCCGTGTTCAAGGTGAAGCTCGAAGAGGTTAACGCTTGGAGAAG
CTCGCTGAGGATGTGCAGACTCGCCTGCCGCGTTTGAACGAGTGGGTGGCGGAGTACAAGGTGTAC
CGTCGAGAGGTGAAGAAGCGACACATCAAGGGCGACACTGAGCAGGTGACGCCGCCCAAGATGCCG
GAGGACCTCACCATCTACGACGCAGACCCGAACCTGCAGGACAGTGATGATGAGGAGGATGCGGGG
GGCGCAGCTGGCGGCAACCCTAACAGCACCACCAACAACAACAAGAACGATACCGCCGCCGCCGGC
GGCGGCGGCGGCAGCGGCAGCCTCAGTTTGCGCGGCTTGAAGCAGCGGGAGACCGGGAAGGAGGTT
GATGCTGCTGACCGTGTCTAG
```

SEQ ID NO: 505, protein – Volvox carteri
```
MCRYAKDIDLKPKRLPNGLLSWIYPVITYPEGDIIDEAGLDCAMYLRILRFGVYLFFPLTIFCIIV
VLPPNMKSNGIEAILAEQALRNAGKNQTSGKGDLEFSDFDHYSLSNVEAASPKMWAHLFAVYCVVL
YTLWLLWRFNRESVLLRLLFLGNAKRGGPSHTVLVTDIPGISEAVSKALRDERAKKQEMKKMERDK
SIISQKSVDVQLDDDSYAELPDQPRTATTSVASTTLKPQTSLRKGRVVSISEPPVLVVQQQQLQQQ
QQQFTPRAVPSVEKGGRSNVSASPFSDASAKSFESTADAELPGSSTKPEVVELKSAASASGGAAAG
GGPAGPAGGASFVVKAGGNSRFNLRSILSSTASDAQYRLVVDDLDPKYAATGGKLELARVGKTNEE
ILKELQVMEKDDLVKGLPEKLGVDTRPLPPTRRNTKRYEYDLKTTVLDPVHEALETLRKGVTPQQL
VAREFALVYGTSNVAAVNMIQDTSALEPLAEEYNQARVCQDLDDYLEMAKLRLKLRKALPQKQISI
LCARYQDMDYVKKFKTKWFVKVDAVEFWLERMKYLRERIKIEQAKCVRKMAPSAFVTFNTRMAQAV
SANSLHSHDENAWRVQNAPAPFEVVWKNLSLTMPIKNGRLYLLWAAFWGMTIFFMVPVSFIQGMIE
VPKLASIPVLGDIVTTPPIKQLLQAVIPGLVLKIFLALVPTILRIMAQLSGATSVSEIDFGVVKRF
FLFQTVVVFFGSIILGSFFNQLKQWVKEPSSVIATLGKSIPMTSTFFITYLLVNGLGVKSFAFIRL
PNFVIYWILSKFAGSPAARQRMWMFQWTNNGTTVVDHTIAMMLGLTFSCINPIVCPAALAYFLVNF
LGETYNNVYVYRRQYESGGMLWKTVYNQVMVALYIMQITMLGLLSLKKFKFSPFMFPLIIFSITSH
ISTLQLFNRPWSVTALHDAAYMDMLEADQRRMTLLAAAREERKKKRDKIKRAYDDAVRQAENNDDP
PPPYDTRLDEVPSPGYPGAGKAELLLLESIEGDGYALNSQEKREVEEMYMNPVFKVKLEEVERLEK
LAEDVQTRLPRLNEWVAEYKVYRREVKKRHIKGDTEQVTPPKMPEDLTIYDADPNLQDSDDEEDAG
GAAGGNPNSTTNNNKNDTAAAGGGGGSGSLSLRGLKQRETGKEVDAADRV
```

SEQ ID NO: 506, DNA – Chlamydomonas reinhardtii
```
ATGCGCTTGCGTCCGTGGGCCAAGCGCTTCTTTGGCCCCAGAAGATACGCCAAAGATGTGGACATA
AAACCCAAGCGGCTCAGCACAGTCCTGATGGGCTGGATAAAGCCGGTGATGCTGTACAAGGAGGAG
GACATTATTGATGAGGTTGGTCTGGATGCGGCCATGTACCTCCGTGTGGTATGGTTCGGCATGGAG
GTGTTTTTCGTGCTGACGCTGGAGGAAGCATTGAACGGCAACACAACCGTCACCGCCAACACCACC
ATCTTTGCCAGGGACCTAACGGTGTCGTACCCCATCTCGGCCGGATCCAGCACGCTCGAGACCCAC
```

FIGURE 24 (continued)

```
TCGTACACCAACGCCCGCATCACCTTCAACGGTACCTCAACCGACCTGTTGCTGAACCAGACGTAC
AACTACGTGATCGCCGGTAACGGTACGGCAAACTTCACGGGCACAAATGTCGACACCGGCGTCGTG
ACGTACATGTTCTTGCGCCAGACCGTGCTGAGCGTGAGCTCGCCCTCGCTCCTGGCGACTGGTGCC
CGGACCATACCAAACGGCACGGTTTTCAACCAGACCAACGAGGAGGTCTTGCTGGTGGCGCTCACC
TCGCCCAACTCCGACACGTCCGTGACGGTCAACGGCCAGCAGTTCAAGTTCACCAACTTCGACCGC
TACTCGCTGTCCAACGTGTCACCGGGCGATGAGGTGATGTGGTGCCACATGGTCGCCGTCTACATC
AGCGCCATCTTCGTGCTGTGGTCGGTGTACCTGCGGCTGCTTTTCCTGGGCAACGCCAAACGCGGC
GGCCCCAGTCACACCGTGCTGGTCACCGACGTGCCCTACGTCAACGAGGCCCCCAGCATGAAGCAA
GCCGCCAAGACGGGCGCGGGCTCTGTTGCGGGCGGCGGTGGCGATGGACCGGAGGGCGGCAAGGCC
CCCGGCCCTGGCCCCGAGGGCGCGGGGCTGGCGTTTCGGCTAAAGATGTTAGGCGAGGATTTGGAC
GAGTGCATGAAATACAGATTGGAGGATCCCTCGATCGATCCTGCCTTCGCCAGCACCGGCGGCCAG
CTGGAGGCGCCGCGCACCGGCCGCACCGCCGAGCAGCTGCTGGCAGATCTGGAGCGCGAGGAGCCC
GAGCCCACGTGGCTGCCTCCGGGGTACGGCGTCGACACGCGTGTGCTCAAACCCGACCGCCGCGCG
CTCAAGCGATTCAGGTATGACGTGAAGACGATGAAGGCCCGCAACGAGATCACCGAGACCGGCAAG
AAGGGCCCGGTGGGCGCAGTCACCATGGACCCAATTTACCAGGCCAGGTCGAAGCTGCAGTCGGGC
CTGACGCCGCAGCAGATGGTGGCGCGGGAGTTCGCGCTGGTGTACCAGCCCTACAACATCGCCGCA
GTCAACATGATCCAGGTGATGCAGTCGCTGGAGGACTACCTGGACATGGCCAAGCTGCGACTCAAG
CTGCGCAAGGCACTGCCGGTGGCCGAGGTGCGCATCTGGCCCAAGCTGCAGGGCGAGGGCGTGTGG
CCGCGGGTGCGGCTGGAGATGACCCGCGTGCTGCGGGCGCAGTGGCACGCGCTGGATGAGGACGTG
ACGGCTGAGGAGGACCCGCGGGACAAGGCCCCAACTAACGGTGTGTGTATGTGTGTATGGAAAC
ATGCGAGGGGCGGCGGCGGGAAGAGATCCGGCTGGACCAGCTCGGCAAGGACCGTGGACGCGGTG
ACGTACTGGCTTGCCAAGCTCAAGTACCTGCGGGAGCGCATCCGCACGGAGCAGCGGTGGCGGGT
CGCAAGCTGGCGCCCAGCGCCTTCGTCACCTTCAACACGCGCATGGCCCAGGGCGTGGCCTCCAAC
TCGCTGCACGCACACGACGAGACCGTGTGGCGTATCAGCGGCGCACCCGCGCCCAACGAGGTGGTG
TGGCGCAACCTGCCCATGACGCACCCCGTGCGCAGCGGCCGCCTCTACATCCTGTGGATCCTGTTT
TGGCTCATGGCGCTGTTCTTCATGATCCCCATCTCCGCCATCCAGGCGCTGATCGAGGTGCCCAAG
CTGGCGTCCGTGCCGGTGCTCGGAGACATTGTCACGATCGACTTTGGCGTCGTCAGCCGGTTCTTC
CTGTTCCAGGTCATTGTGGTGTTCTTCGGATGCATCATCGCCGGCTCCTTCTTCAACCAGCTGAAG
CAGTGGGTAGAGGACCCCGCCTCGGTCATCTCCACTCTGGGCAAATCCATTCCCATGACCGCAACC
TTCTTCATCACCTACCTCTTCATCAACGGCCTGGGCGCCAAATCCATCGCCTTCGTGCGGCTTCCC
GGCTTCATCATTTTCTGGATCCTGTCCAAATTCGCTGGATCTCCTCGCGCCCGCGAGCGCATGTGG
ATGAACCAGAGCGCGCGGTACGGCATCCTGGTGCCGGACCACACCATGGCCATGCTGCTGGGTCTG
GTGTTTTGCTGCATGAACCCGATCGTGTGCCCCGCCGCCCTCGCGTACTTCATTGTGGCGAGTGTG
GGCGAGCGGTACAACTTCATCTACGTGTACCGCCAGGTTTACAACCAGATTATGGTGGGGCTGTAC
ATCATGCTGCTGACCATGTTTGGCCTGCTCGCGATCAAGAAGTTCAAGTGGGTGTTCTTCCTGCTG
CCCATCATCGCCGCCGCCGTCATCAGCCACATGGCTACACTCAGCTTATACAGCCGGCCTTGGTCG
GTGACTGCGCTGCACGACGCGGCTGAGATGGACATGCTGGAGGCGGACCAGCGCCGCGAGCAGCTG
CTGGCGGCGGCCCGAGAGGTGGGCGGGGAGCGCAAGAAGGCCAAGGAGGCGCAGCGGCGGCGCTAC
GAGGAGGCCTGCATCGAGGCGGAGAAGGCCGACGCAGAGGAGCTGCCCAAGCGGGAGGAGTTCTTC
GTGCCGCTCACCCCCGGCCCGGCGGAGCTGCTGCTCAAGGAGTCCCTGCGCGGCGACGGCTTTGCG
CTCAACAGCGCGGAGAAGAAGGAGATCGCCGACATGTACCGCAACCCCGGCTTCACGATGGCACTG
GAGCAGATTGAGGAGGTGGAGAAGCTGGCCCGGGTGGTTCAGCTGCTGCTGCCGCCGCTCAACCAG
TTTGTGAGCGAGTACAAACTCTACAGGCGCGGCGTGAAGGCTTCCAAGCTCAAGGGAAGTACGGAG
GACGGGCCGGAGGCGCCGCACATGCCCGAGGACCTTACGATCTTCGACAACGACCCGCGCCTGGTC
GGGCTGGACCGCGAGCTGGGCGAGGGCGGCGGCGGCGGAGACGAAGACGAAACGTCCAGTCTGGGG
GAGCGCGACAGCGCCGGCGGCCTGCGCGATGGGGAGCTGGCGCCCGTGCCGGTCGCAAGGTCGCAG
TCGCAGGCGGCTCGGCGCAAGTGA
```

FIGURE 24 (continued)

SEQ ID NO: 507, protein - Chlamydomonas reinhardtii
MRLRPWAKRFFGPRRYAKDVDIKPKRLSTVLMGWIKPVMLYKEEDIIDEVGLDAAMYLRVVWFGME
VFFVLTLEEALNGNTTVTANTTIFARDLTVSYPISAGSSTLETHSYTNARITFNGTSTDLLLNQTY
NYVIAGNGTANFTGTNVDTGVVTYMFLRQTVLSVSSPSLLATGARTIPNGTVFNQTNEEVLLVALT
SPNSDTSVTVNGQQFKFTNFDRYSLSNVSPGDEVMWCHMVAVYISAIFVLWSVYLRLLFLGNAKRG
GPSHTVLVTDVPYVNEAPSMKQAAKTGAGSVAGGGGDGPEGGKAPGPGPEGAGLAFRLKMLGEDLD
ECMKYRLEDPSIDPAFASTGGQLEAPRTGRTAEQLLADLEREEPEPTWLPPGYGVDTRVLKPDRRA
LKRFRYDVKTMKARNEITETGKKGPVGAVTMDPIYQARSKLQSGLTPQQMVAREFALVYQPYNIAA
VNMIQVMQSLEDYLDMAKLRLKLRKALPVAEVRIWPKLQGEGVWPRVRLEMTRVLRAQWHALDEDV
TAEEDPRDKAPTNGVCVCVYGNMRGGGGGKRSGWTSSARTVDAVTYWLAKLKYLRERIRTEQAVAG
RKLAPSAFVTFNTRMAQGVASNSLHAHDETVWRISGAPAPNEVVWRNLPMTHPVRSGRLYILWILF
WLMALFFMIPISAIQALIEVPKLASVPVLGDIVTIDFGVVSRFFLFQVIVVFFGCIIAGSFFNQLK
QWVEDPASVISTLGKSIPMTATFFITYLFINGLGAKSIAFVRLPGFIIFWILSKFAGSPRARERMW
MNQSARYGILVPDHTMAMLLGLVFCCMNPIVCPAALAYFIVASVGERYNFIYVYRQVYNQIMVGLY
IMLLTMFGLLAIKKFKWVFFLLPIIAAAVISHMATLSLYSRPWSVTALHDAAEMDMLEADQRREQL
LAAAREVGGERKKAKEAQRRRYEEACIEAEKADAEELPKREEFFVPLTPGPAELLLKESLRGDGFA
LNSAEKKEIADMYRNPGFTMALEQIEEVEKLARVVQLLLPPLNQFVSEYKLYRRGVKASKLKGSTE
DGPEAPHMPEDLTIFDNDPRLVGLDRELGEGGGGGDEDETSSLGERDSAGGLRDGELAPVPVARSQ
SQAARRK

SEQ ID NO: 508, DNA - Chlamydomonas reinhardtii
ATGCTGGGGCTGTTCACGCTGTTCACAATCGTTCGTGTGAGGCCATGGGCGAAGCGCTTCTTTGCG
CCAAGAAGATATGCAAGAGATGTAGACTTGAAGCCAAAACGCATGAGCAGCTTCTACCTGGGATGG
GTGAAGCCCATCATGTTGTATAAGGAGGAGGACATCATTGACGAGGTGGGCCTGGACGCGGCCATG
TACCTGCGGGTCCTGTGGTTCGGCATGGAGCTGTTTTTCATGCTGACGCTCATTTGCATCCCGCTC
GTCCTGCCCACCAACATGACCAGCGGGGAGATCGAGCGGCTGCTGGCACAGGCGGAGGAGGCTCAA
TCGCTGGTTTTGAATAATTCGGTGGTTGTGCAGCCGCGCAATACCAGCCTCCTCGGCGATGACAAC
CACAACGACGTCCGCTTCATGTACATGTCCCAGGGCACGGTGGTCGCCAACAACATGGCTCCTTGG
AACACGAGCATCACGTTCAACGCGACGATGGTGGAAAACAACGTCACGTTTGTGCAGGACTTCTTT
TCCAACTACAGCTGCAAGGACACAGCTGAGCCGTACCTATCCTTTGCGGCGTACAACATGACTTAC
GTACGCATCAGCGGCACCAAACGCTACAACAACGACTCGCTAACAGTCCTGCTGAAGGACGCGATC
GTATTTCTGGGCTGGCAAAACATGAGCGTCATTCCCGCCAGCCTGCAGGCCGTGAATAACTCAGGC
TTTGATTACATCATCGTGTGGTCGCTGGAGGGCGAAACGGAGCAGACGCAGCTGACGGTCAACGGC
AAGGAGTTCAAGTTTACAAATTTTGACAAGTACTCGCTGTCAAACATTCCAGCCGGCAGCGCCAAG
ATGTGGGCGCACGTGGTAGCGCTGTGGCTTGTGACGCTGTTCACTATGTGGCGCCTGAGAGAGTAC
AACTTACAGTCGGTGTATCTGCGGCTGCTCTTCTTGGGTAACTCCAAGCGAGGAGGCCCCTCACAC
ACCGTCCTGGTCACCGACGTACCCTTCGTGTCTGACGCGGTTGCGTGCGGCCTGCGCGCAGAGGAG
TACCGTGAGAAGCACGGCCTGCCCGCGAGCGTGACCAGCCTGAAGAAGAGCATGAGCATCAAGAAC
CCCATGTATGAGGGTTACGAGTCGCTGGAGGGCGGCCCCGACGGCAGGACGGCGGTGGGCGTGCCC
GTGTCCACCAGCGCGGGCGAGCCGCGCCTGCCCGGCACCAAGTCCGTCACCATCGTGGAACCCGGC
GGCAAGAACGGCGCCGGCGGCGCGGCACAGCAGCCTGCCAGCTCGCTACGGTCGTCGCAGGCGGCG
TCGCTGAAGCAGTCGCAGGCGGGCGCGCTCAAGGTCCACACCACCAACGGCGGCGGCGCGTACGCG
GCGGAGACGCCGCGCGCCAACGGCGGCGGCTCCACTGCCCAGTCCGGCGACATGCGCGTGTCGGAG
TTCGCCTCCGCCACCTACGAGGCCGAGTCAGCCGCCGGAGGGGACAAGCGCTCCGCCGCCGGCGAC
TCTGGCGTCGGCGGCAAGGAGGGCGGCGCCGTGGTCCAGGCCGTGGGCGTGCCCATCGAGGAGTGC
CTCAAGTACCGGCTGCACGACCCCGAGGTGGAGCCCCGGCACGCCGCCACCGGCGGCAGGCTGCTC
ATGGCGCGCGTGGGCCGAACCACTGAGGAGCTCAGGCGCGACGTGCTGCGCGAGGACCCGGAGCCC
ACCTGGCTGCCTCCCGGCTACGGCGTGGACACGCGCGTGCTCAAGCCCGACGCCGCTCGCTGAAG

```
CGCTTCCGCTACGACGTCAAGACGCTGGGCAAGAAGCCCGGAGACATGGTACTGTGGATGCGGGAC
AAGGCCGCGCAGCTGCTGGGCGGCAAGAGCCACGAGGACAAGGAGAAGGAGAAGGCGGAGCTGGAT
GCGGCGCGCATGAAGCGCGAGGCCGAGGACAAGGACCACATCGGCCCCCGCTTCCGCCCGCCCGTC
AACGCCACAGCTATGGACCCGAAGGAGCAGGCCAAGGCCAAGCTGCGGTCGGGCCTGACGCCGCAG
CAGATGGTGGCCCAGGAGTTCGCGCTGGTGTACCAGCCCTACAACATCGCCGCCGTAAACATGATC
CAGGACACCACTGGCCTGGAGCCGCTGGTGGCCGAGTACCTCAAGATTGAGCAATCCCTGGAGGAC
TACCTGGACATGGCCAAGCTGCGCCTCAAGCTGCGCAAGGCGCTGCCCATGAAGATTGTGCGCATC
AGCCCCAAGCTGCAGGGTGACGCCTGGCCGGCCGTGCAGAGCGAAATGATCCGGATCGTGAAGAGC
CAGTACGAGTACATGCGGGAGCAGGCGCACGCGCGCTCCAAGCAGGCACTGGAGCTCCACGACCGT
GAAATCAACCCCAAGGCAAGCAGGAGCTCGCGGCGCGCGGAGAAGGACGTGCTGCAGAAGCGAGCG
GTCGCATTGGGCGCTGAGGAGGCGAACCTGCCGAGGCAGGAGGCGGAGGCGCTGGCGGCAATCCAG
AAGATCATGCCCAAGAGATGGAGCGCCAAGGTGGACGCGGTGACCTACTGGCTGGCCCGGCTCAAG
TACCTGCGGGAGTGCATCAAGATCCAGCAGGCGGTCGCCAGCCGCAAGATCGCGCCCTCCGCCTTC
GTCACCTTCAACACGCGCATGGCCCAGGGCGTGGCCTCCAACTCGCTGCACGCGCACGACGAGACC
AGCTGGCGCATCATGCCGGCGCCCGCGCCCATCGAGGTGGTGTGGGGCAACCTGATGATGACGCAC
CCCGTGCGCACCGGCCGCCTGTGGCTGATCTGGGTGGCGTTCTGGGCCATGACGCTGTTCTTCATG
ATTCCCGTCACGCTCATCCAGGCGCTGATTGAGGTGCCCAAGCTGGCGTCCATCCCGGTGCTCGGT
GACATCGTGACGGCGCCGGTGGTGAAGCAGCTGCTGGAGGCGATCATCCCGGGTACGTGTCGTGTG
GTGGTGGTGTTCTTTGGGTCCATCATCGCCGGCTCTTTCTTCAACCAGATCACGCAGTGGGTCAAG
GACCCTGCCTCCGTCATTTCCGTGCTGGGCAAGTCCATTCCCATGACCGCCACATTCTTCATCACC
TACCTCTTCGTGAACGGCCTGGCGGTGCGCTCCATCCAGTTTGTACGCCTGTCCGACTTCGTGGTC
TTCTGGATCCTGTCCAAGTTCGCGGGCTCGCCGCGCGCGCGCGAGCGCATGTGGATGAACCAAGTC
CAGTTCTACGGCAAGACCGTGCCGGACCACACCATCGCAATGCTCCTGGGCCTGGTCTTCTGCTGC
ATGAACCCCATCGTGTGCCCGGCGGCCCTGGCGTACTTCCTGGTGGCGTGCGTGGGAGAGCGCTAC
AACGTCATCTACGTGTACAGGCCACAGTACGAGAGCGCTGGGCGGCTGTGGAAGACGGTCTACAAC
CAGATCATGGTTGCAATCTACATCATGCTGCTCGCCATGTTTGGCCTGCTGGCCATCAAGAAGTTC
GCGGCCACATTCCTGCTGGTGCCGCTCATCATCGGCGTACTGCTGTCGCACCTCTCCACGCTCACG
CTCTACAGCCGCCCCTGGACCGTCACGGCGCTGCACGACGCTGCGGAGATGGACATGCTGGAGGCG
GACCAGCGCCGTGAGCACCTGCTGGCCATGGCGCGAGACGAGCGCAAGAAGGCTAAGCTGGAGCAG
AAGCAGCGCTACGAGACCGCCTGCATCGCGGCGGAGAAGGAAGACAAGCCCGCCCCGCCAGCGTCC
GACTTCTTCACGGAGATCAAGCCGGGCAAGGCCGAGCGGCTGCTGTATGAGACGCTCGAGGGCGAA
GGCTTTTCGCTCAACAGCGCAGAGAAGAAGGAGATCGCCGACATGGCGGTGCCGCCCACCTGCCTT
GAGGGCGGCGTAAGGATGCACCTGGAGCACCTGGAGGAGGTGGAGAAGCTGGCGCGGGTGGTGCAG
AGCCTGCTGCCCTCGCTCAACCAGTTCGTGTCCGAGTACAAGAACTACCGCCGCACCGTCAAGGCC
CACAAGATCAAGGGCGACACCGCGACCGGCGCCGAAGTGCCGCACATGCCCGAGGACCTTACGATC
TTCGACAACGACCCGCGCCTGGTGAGCCTGGACCAGGAGATGGCGGATCGGCCCGACGACGCCGCC
TCGCTGTCGGCGGCGGAGGCCAGCGACGACGACGAGGAGCGGCTGGGCCGTGACGTGGAGGCGGCG
CTGGGCATGGAGCTGCAGGAGACCAAGAGCGCGGCCGCCAGCTCCAAGGGCTTCAAGCAGGTCTGA
GGTGTCCATGTGGTGGTGGAGGGCGGATGGGAGGAGGT
```

SEQ ID NO: 509, protein - Chlamydomonas reinhardtii
MLGLFTLFTIVRVRPWAKRFFAPRRYARDVDLKPKRMSSFYLGWVKPIMLYKEEDIIDEVGLDAAM
YLRVLWFGMELFFMLTLICIPLVLPTNMTSGEIERLLAQAEEAQSLVLNNSVVVQPRNTSLLGDDN
HNDVRFMYMSQGTVVANNMAPWNTSITFNATMVENNVTFVQDFFSNYSCKDTAEPYLSFAAYNMTY
VRISGTKRYNNDSLTVLLKDAIVFLGWQNMSVIPASLQAVNNSGFDYIIVWSLEGETEQTQLTVNG
KEFKFTNFDKYSLSNIPAGSAKMWAHVVALWLVTLFTMWRLREYNLQSVYLRLLFLGNSKRGGPSH
TVLVTDVPFVSDAVACGLRAEEYREKHGLPASVTSLKKSMSIKNPMYEGYESLEGGPDGRTAVGVP
VSTSAGEPRLPGTKSVTIVEPGGKNGAGGAAQQPASSLRSSQAASLKQSQAGALKVHTTNGGGAYA

FIGURE 24 (continued)

```
AETPRANGGGSTAQSGDMRVSEFASATYEAESAAGGDKRSAAGDSGVGGKEGGAVVQAVGVPIEEC
LKYRLHDPEVEPRHAATGGRLLMARVGRTTEELRRDVLREDPEPTWLPPGYGVDTRVLKPDRRSLK
RFRYDVKTLGKKPGDMVLWMRDKAAQLLGGKSHEDKEKEKAELDAARMKREAEDKDHIGPRFRPPV
NATAMDPKEQAKAKLRSGLTPQQMVAQEFALVYQPYNIAAVNMIQDTTGLEPLVAEYLKIEQSLED
YLDMAKLRLKLRKALPMKIVRISPKLQGDAWPAVQSEMIRIVKSQYEYMREQAHARSKQALELHDR
EINPKASRSSRRAEKDVLQKRAVALGAEEANLPRQEAEALAAIQKIMPKRWSAKVDAVTYWLARLK
YLRECIKIQQAVASRKIAPSAFVTFNTRMAQGVASNSLHAHDETSWRIMPAPAPIEVVWGNLMMTH
PVRTGRLWLIWVAFWAMTLFFMIPVTLIQALIEVPKLASIPVLGDIVTAPVVKQLLEAIIPGTCRV
VVVFFGSIIAGSFFNQITQWVKDPASVISVLGKSIPMTATFFITYLFVNGLAVRSIQFVRLSDFVV
FWILSKFAGSPRARERMWMNQVQFYGKTVPDHTIAMLLGLVFCCMNPIVCPAALAYFLVACVGERY
NVIYVYRPQYESAGRLWKTVYNQIMVAIYIMLLAMFGLLAIKKFAATFLLVPLIIGVLLSHLSTLT
LYSRPWTVTALHDAAEMDMLEADQRREHLLAMARDERKKAKLEQKQRYETACIAAEKEDKPAPPAS
DFFTEIKPGKAERLLYETLEGEGFSLNSAEKKEIADMAVPPTCLEGGVRMHLEHLEEVEKLARVVQ
SLLPSLNQFVSEYKNYRRTVKAHKIKGDTATGAEVPHMPEDLTIFDNDPRLVSLDQEMADRPDDAA
SLSAAEASDDDEERLGRDVEAALGMELQETKSAAASSKGFKQV
```

SEQ ID NO: 510, DNA - Saccharomyces cerevisiae
```
ATGGCTGACAGTTCTTCGACTTCGGCGTTCATTTCAACCCTGATTATCTACGGTCTTACCGCCGTC
GTGTTTGTCTGGCTCTTTTTGCTATTGCGGCCCAAGAATAGAAGAGTATACGAGCCACGGTCTCTT
AAGGACATTCAGACTATTCCGGAGGAAGAGAGAACGGAACCAGTTCCTGAAGGCTACTTCGGGTGG
GTTGAATATCTACTCTCGAAACCGCACTCGTTTCTCATCCAGCACACAAGCGTGGACGGCTATTTT
CTGTTAAGATATATCGGTATCGTGGGTTCACTTTCGTTTGTGGGCTGTTTGCTTCTTTTACCGATA
TTGCTTCCCGTGAACGCTACCAACGGTAACAACCTTCAAGGCTTTGAACTGCTATCATTTTCAAAT
GTTACCAACAAGAACAGGTTTTACGCGCACGTTTTCCTCTCGTGGATCTTTTTTGGCCTGTTCACC
TATGTCATCTACAAGGAGCTGTATTACTACGTCGTGTTTAGACATGCTATGCAGACAACACCACTC
TATGACGGACTGCTGTCTTCTAGGACGGTTATCGTCACAGAATTGCACAAGAGCATCGCTCAAGAG
GGGGAGATGCAAATGCGTTTCCCCAAGGCTTCCAATGTGGCCTTCGCGTATGATCTCTCAGACTTG
CAAGAATTGTGTAAAGAAAGAGCTAAGAACGCTGCGAAGTACGAAGCTGCGTTGAATAAGGTTCTA
AACAAGTGCGTGAAAATGACCCGAAACAAGACCCAAAAGCAACTTGACAAGTTGTACAATAACGGT
ACCAAGCCAAAGGACGATTTAGAGACATACGTGCCACATAAAAAGCGCCCTAAACATCGTTTGGGA
AAATTGCCGCTTTGTCTAGGCGGCAAAAAAGTTAATACGTTGTCTTATTCTAGTAAAAGGATTGGG
GAATTGAACGAAGAGATTCATGAAAAACAAGCCGATTGGGCCAGTAATGATAGGCAACCTGCCTGC
TTTATCCAGTTCGAGACTCAATTGGAAGCGCAAAGATGCTACCAATCTGTGGAAGCAATCTTGGGT
AAGAAAAATTTTGGTAAGCGTCTTATTGGCTACTCGCCAGAAGACGTTAACTGGGGCAGCATGCGT
CTCAGTTCAAAGGAGAGACACTCCAGGAGAGCTGTGGCAAATACAATCATGGTGTTATTGATTATC
TTTTGGGCTTTCCCCGTTGCTGTGGTTGGTATCATCTCCAACGTCAATTTCCTTACCGATAAAGTT
CCCTTCTTACGTTTCATCAACAACATGCCCACCTTCCTGATGGGTGTCATTACTGGTTTGTTGCCT
ACTATTGCGTTGGTCGTTTTGATGTCTCTAGTGCCACCTTTTATCGTAATGTTGGGGAAACTTAGT
GGTTGCGTCACTAGGCAAGAAACGGATCTATACTCCCAAGCATGGTATTACGCTTTCGCTGTGATT
CAAATCTTTTTAGTTGTCACCGCTACCTCTTCTGCATCTTCCACCGTTGACTCGATTATTGACAGA
CCAAGATCCGCCATGACACTATTGGCAAATAACTTGCCAAAGGCATCCAACTTTTATATCATGTAC
TTCATATTGAAAGGTTTAACTGGCCCCACATGGACGATCTTGCAGGCAGTTAACTTGCTGCTAAGT
AAAGTCCTAGGTAGAGTGTTGGATTCTACCCCAAGGCAAAAATGGAACCGCTACAATACTTTGGCC
ACGCCGCGCATGGGCATTGTTTACCCAGGCATTGAAATTCTGGTTTGCATTTATATCTGTTACTCG
ATTATCGCCCCTATACTGCTATTTTTCAGTACCGTAATGTTGACGCTACTTTATGTGGCGTATTTG
TACAATTTAAACTACGTGTTTGGCTTCTCCTTCGATTTAAAGGGGCGCAATTATCCAAGAGCACTT
TTCCAGATTTTTGTTGGAATTTACTTGAGTGAAGTATGTCTGCTTGGACTGTTTATCATGGCAAAA
ACCTGGGGTCCTTTGGTCCTGGAAGTGTTTTGGATCGTGGTCACTGCCCTAGCTCATATATATATG
```

FIGURE 24 (continued)

```
AAGAGGAAATTCATACCGCTATTCGACGCAGTTCCTTTAAGCGCCATCAGACATGCAAGAGGTGAG
CCCGGCTATTCCTATCCTACATCGGACTTGGGTCTCCAGGAAATCAAGGACATTGCAGATGAAATG
AAGGGCAAATACGAACAAGACAATACACACGGGATTTTGACGCCCGTGACCAAGGATGATTTGAAA
AAGGCCAATCTGATACCAGATAACGATGGCAGCTCAGAGAACGGTACTCCTAGTAACCCCTTTGAG
TCTGGTTCTGAACGTGCCTCTCTCTGGATCGAACGCAGAGAGTGACTCGATCAAGAAATTAAAT
GATACTGTTATCAAAAAATCAAGCACTCTCTCCTCCTCTACCAAGGACAACAACGAATCTACTTTT
GTTCCAGAGGGTGAAAAGTTTCGCAAGTTTCACTACAGCGATGTTGAGGCATTGAGAAATAAGCGC
CCTTATGATGAGGATGATCATAGTAAACATGGACCTGAAGGTGCCGTGCCAGTAAACGCTGACGCG
GGAGTTATTTACAGTGATCCGGCAGCTGTCATGAAAGAGCCTCAGGCATTTCCTCCGGATGTTTTG
GAAACCAATACTTGGACAAGAAGAATTCTACAATTCTTCAACCCAAGAAGGTCGTATCCTTTCGAC
AGTGTCAGGATGAGATTCCCACTTGTTTTCAACACCAGCATCGAATACGATGAAGAATATTTGAGC
TCTGCTTATACCGATCCATGTGTCAGAGAGAAAGATCCCATTGTGTGGTGCTGTAAGGATCCGTTA
GGAGTTTCAAAACAGCAAATTCAAGAGGCTAGGTCTAATGGCTTAGATGTAAGAGATGATTTCACA
AGGTACGATGAAAAAGGAAAAGTCATATTCACTTACAACCCTCCTGATTATGAACCTGAGGCTAAA
AAATGA
```

SEQ ID NO: 511, protein - Saccharomyces cerevisiae
```
MADSSSTSAFISTLIIYGLTAVVFVWLFLLLRPKNRRVYEPRSLKDIQTIPEEERTEPVPEGYFGW
VEYLLSKPHSFLIQHTSVDGYFLLRYIGIVGSLSFVGCLLLLPILLPVNATNGNNLQGFELLSFSN
VTNKNRFYAHVFLSWIFFGLFTYVIYKELYYYVVFRHAMQTTPLYDGLLSSRTVIVTELHKSIAQE
GEMQMRFPKASNVAFAYDLSDLQELCKERAKNAAKYEAALNKVLNKCVKMTRNKTQKQLDKLYNNG
TKPKDDLETYVPHKKRPKHRLGKLPLCLGGKKVNTLSYSSKRIGELNEEIHEKQADWASNDRQPAC
FIQFETQLEAQRCYQSVEAILGKKNFGKRLIGYSPEDVNWGSMRLSSKERHSRRAVANTIMVLLII
FWAFPVAVVGIISNVNFLTDKVPFLRFINNMPTFLMGVITGLLPTIALVVLMSLVPPFIVMLGKLS
GCVTRQETDLYSQAWYYAFAVIQIFLVVTATSSASSTVDSIIDRPRSAMTLLANNLPKASNFYIMY
FILKGLTGPTWTILQAVNLLLSKVLGRVLDSTPRQKWNRYNTLATPRMGIVYPGIEILVCIYICYS
IIAPILLFFSTVMLTLLYVAYLYNLNYVFGFSFDLKGRNYPRALFQIFVGIYLSEVCLLGLFIMAK
TWGPLVLEVFWIVVTALAHIYMKRKFIPLFDAVPLSAIRHARGEPGYSYPTSDLGLQEIKDIADEM
KGKYEQDNTHGILTPVTKDDLKKANLIPDNDGSSENGTPSNPFESGSERASLSGSNAESDSIKKLN
DTVIKKSSTLSSSTKDNNESTFVPEGEKFRKFHYSDVEALRNKRPYDEDDHSKHGPEGAVPVNADA
GVIYSDPAAVMKEPQAFPPDVLETNTWTRRILQFFNPRRSYPFDSVRMRFPLVFNTSIEYDEEYLS
SAYTDPCVREKDPIVWCCKDPLGVSKQQIQEARSNGLDVRDDFTRYDEKGKVIFTYNPPDYEPEAK
K
```

SEQ ID NO: 512, DNA - Schizosaccharomyces pombe
```
ATGTCCGACAGCAGCAGTTCTTCTACGTCGGCGTTCGTATCATCGTTAGTCTTCAATTTTGCTATC
TTTTGCGCCTTCATCGGTCTTTTTTTATGTTTGCGTCCTCGCGAGAAACACGTTTACCAACCTAGA
TGTATTATAGATACTCAACCAAAAGAAGAGAAACCAGAGCCTTCCCCCTCTAGCCCTTTTGGTTTG
TTTGCTTACGTTGTGAAACGCTCTGAGACATATCTTATCCAATACGCTGGTGTGGATGGTTATTTT
TTTATTCGCTATCTCTTCACATTTGGTGCCCTTTGTATCCTAGGCTGTTAGTTCTTTTCCCCATC
CTCCTTCCTGTAAACGCAACAAACGGTGTGGGTGAAAAGGGATTTGATATTCTTTCATTCTCAAAC
GTCAAAAATCATAATCGATTTTATGCCCATGTTTTCTCTCTTGGTTGTTTTTCGGTTTCACCATT
TTCATAATATATCGTGAGCTTCGCTATTATGTTATTTTTCGACATGCCATGCAATCTTCAGGTCTT
TATAACAATCTTCCTTCTTCCTCTACGATGTTGCTGACTGAGCTTCCAAACTCAGTTTTAAACGAT
GAGGAAACTCTTCATGAGCTTTTTCCAAACGCTTCTGAGTTTACATGCGTCCGTGATCTCAAGAAG
CTGGAAAAAAAGGTCAAGAAACGCAGTGACCTTGGAAACAAGTATGAGAGTACTCTTAACAGCCTT
ATTAATAAGTCTGTTAAAAAACATAATAAGCTTGTCAAAAAGCATAAGCCACTTCCTTCAACCTTG
GATTATACCGCTTACGTGAAGAAGCGTCCAACTCATCGCCTTAAATTCTTGATTGGAAAAAAGGTT
```

```
GATACTATTGACTACTGTAGAGACACGATCGCTGAATTGGATGAGGTTGTCGATAAATTACAAACT
TCACTCGAGGAGCGCAAAAAAGTTGGTTCTGTGTTTATCAGATTCCGTAGTCAAACGGACTTGCAA
ACTGCTTATCAGGCCTTCCTTTACTCAAAAAAGTTTAGAAAATACCGTTTCGGTCGTGCTTTGGTC
GGCATTGCTCCAGAAGATATCGTTTGGTCCAATCTTGACCTTTCTATGTACACCAGAAGAGGCAAA
AAGACTATTTCAAATACTATTCTTACTCTTATGATTATTTTCTGGGCATTTCCAGTTGCAGTAGTC
GGTTGTATATCCAACGTTAACTATCTTATTGAAAAGGTTCATTTCTTGAAATTTATCGACCATATG
CCTCCAAAATTGCTTGGTATCATTACAGGAATTCTCCCCTCTGTTGCTCTCTCCATTTTGATGTCG
CTTGTTCCACCGTTTATCAAGTTTTTAGGAAAGTTTGGCGGCGCTCTTACCGTTCAAGAGATTGAA
AATTATTGTCAAAACTGGTATTACGCATTTCAGGTCGTTCAAGTCTTTTTGGTAACTACAATGACA
TCGGCTGCTACGTCTGCCGTTGTACAAGTTATTAAAGAACCAGCATCTTCCATGACACTACTTGCC
AGTAATCTTCCAAAGGCGTCTAACTTTTACATTTCATATTTCCTTTTGCAAGGACTTTCAATTCCT
GGAGGAGCTTTATTGCAAATAGTAACATTACTTTTGTCGAAAGTTTTAGGGCGCATATTCGATAAT
ACACCTCGAAAGAAGTGGAATCGCTGGAATCAACTTTCCGCACCTAGCTGGGGTACGGTTTATCCG
GTCTATTCTTTGTTGGTGACTATCATGATTTGCTACTCGATCATTGCTCCTATTATAATTGGATTT
GCCGCTGTAGCATTTGTTTTAATTTATTTTGCATATTCCTATAATTTAATTTATGTCTTAGGGCAT
AACGCTGACGCAAAGGGCAGAAATTATCCTAGAGCTCTTTTCCAAGTATTTGTCGGTCTTTACTTA
GCAGAAGTCTGCTTAATTGGCTTATTTGTTTTGGCTAAGAATTGGGGCGCTACCGTACTCGAAGCC
GTATTTTTGGGTTTTACGGTGGCATGCCATCTTTATTTCAAATACAAATTTTTACCTTTGATGGAT
GCTGTTCCAATTAGTGCTATCGAAAGTGTTTCCGAGCGACCTGAAATTAAATATCCAATGGACCTG
GGTACGTCTGAAATGAAGAACGTGGGTCGTGCTTATCCCGAAATTCTGGAAAAATTGTCATCATCT
TCTGGAAGTGATGAATTCTTAGAAACAAGTAGCAGAACTTCGGAAAATACCAAAGAAAAAATAGAT
AAGGACGACGAGGGCTTTGCTATTACGAATATCTCATCTGTACATAAAATGCCTAGTTTCGTTTTA
AGTTATTTTTCTGACCTTGCTGCTTCTAATAGGATCCTGACTGGATTCGATCGTGTTTTACAATTA
CTTCCTTCATTTTACGATATTCCTGTGCGTGTACGTAATGTACAATATGTGAGTCCTGCTTTGAAA
GCTACACCACCATCAGTTTGGATTCCAAAAGATCCTCTTGGATTGTCGACCTATGCAATTGAGGAT
GCGCGTGGAAAGGTGGATATTTTCGACGATAACACAACATTTAATGAGAAGGGTAATCTCCAATAT
ACTGGTCCACCTCCCGACTACGATGAGGCGATCAGGAGTTAA
```

SEQ ID NO: 513, protein - Schizosaccharomyces pombe
MSDSSSSSTSAFVSSLVFNFAIFCAFIGLFLCLRPREKHVYQPRCIIDTQPKEEKPEPSPSSPFGL
FAYVVKRSETYLIQYAGVDGYFFIRYLFTFGALCILGCLVLFPILLPVNATNGVGEKGFDILSFSN
VKNHNRFYAHVFLSWLFFGFTIFIIYRELRYYVIFRHAMQSSGLYNNLPSSSTMLLTELPNSVLND
EETLHELFPNASEFTCVRDLKKLEKKVKKRSDLGNKYESTLNSLINKSVKKHNKLVKKHKPLPSTL
DYTAYVKKRPTHRLKFLIGKKVDTIDYCRDTIAELDEVVDKLQTSLEERKKVGSVFIRFRSQTDLQ
TAYQAFLYSKKFRKYRFGRALVGIAPEDIVWSNLDLSMYTRRGKKTISNTILTLMIIFWAFPVAVV
GCISNVNYLIEKVHFLKFIDHMPPKLLGIITGILPSVALSILMSLVPPFIKFLGKFGGALTVQEIE
NYCQNWYYAFQVVQVFLVTTMTSAATSAVVQVIKEPASSMTLLASNLPKASNFYISYFLLQGLSIP
GGALLQIVTLLLSKVLGRIFDNTPRKKWNRWNQLSAPSWGTVYPVYSLLVTIMICYSIIAPIIGF
AAVAFVLIYFAYSYNLIYVLGHNADAKGRNYPRALFQVFVGLYLAEVCLIGLFVLAKNWGATVLEA
VFLGFTVACHLYFKYKFLPLMDAVPISAIESVSERPEIKYPMDLGTSEMKNVGRAYPEILEKLSSS
SGSDEFLETSSRTSENTKEKIDKDDEGFAITNISSVHKMPSFVLSYFSDLAASNRILTGFDRVLQL
LPSFYDIPVRVRNVQYVSPALKATPPSVWIPKDPLGLSTYAIEDARGKVDIFDDNTTFNEKGNLQY
TGPPPDYDEAIRS

SEQ ID NO: 514, DNA - Ashbya gossypii
ATGGCAGACGCTAACGACAGTTCAGACTCGAACTCAACGTCCTCCTTTGTTTCGGCGCTGATTTTA
TATGGGATCATCGGGCTAGTTTACACGCTCATCTTCCTCGCGCTGCGCAAGCGCTACAGACGGGTG
TATGAACCACGGACCCTCGACGATGTGCGCACGCTACAGCCTTCGGAGCGGGTGGAGTCGGCACCG FIGURE 24 (continued)

```
GCGGGGTACGTCTGGTGGCTGCCACACCTGCTCTACAAGCCCCACAAGTCACTGCTGCAGCACATG
GGCGTGGACGCGTACTTCTTCGCACGCTACTTGGCCGTGTTTGGGACGCTGGCGTTGATAGGGTGC
TTTATTCTTTTGCCGATCCTGTTGCCCGTGAACGCGGCGGGCGGCCGCCACCTCCGCGGCTTCGAG
CGCATATCCTTCAGCAACGTGGCCATGAGCCGGCGCCTGTACGCGCACGTGTTCCTGTCGTGGATA
TTCTTTGGGCTCGTGCTCTACGTGATCTACCGCGAGTTGTACTACTATGTGTCCATGCGCCAGGCG
CTGCAGACCTCGCCCTACTACTCGTCGCTGCTGCAGTCCCGGACGGTGCTATTCACGGACGTGCGC
GGCGGCACTGACGCGGAAAGCGTGCTGCGGGGCGCCTTCACTGGCGTGGAGGAGGTCGTCTACGCA
AAGGACCACACAGAGCTCCGCAAATTAGTGAAGGAGCGCAACAAGACTGCAAACAAGTACGAGTCC
GCCCTTAACAAGGTGGTGAACAAGAGCGTCAAGGTGCGCCGCAAGGCCGAGCTCAAGGGCAACACT
GTGTTGCAGCAGCGGGAAGACCTCAAGGACGATGACTTCGAGCGCTACGTGAAAAAGAGGCCCACC
CACAGACTTGGCAAAATACCTTGCGTCGGAGAGAAGGTAGACACCCTGAAACACTGCGCAAGCCGC
CTGGGGTCGCTCAACTCGCGCGTGAAGTCCGAGCAGGAAGAGTGGGAGACCAGCCAGCCTCTAAAT
ACGTGCTTTGTGATTTTCTCTACGCAGCGCGATGCCCAGGAGGCTTACCAGCGGGCGCCCGTGGCC
TTGCCCAAGGGCTCCTACGACCGCTGTATCATAGGCTGTGCCCCAGACGATGTGAACTGGGACAGC
CTTTCAATGAGCAAGAGCGTGCGCAGGTCGAAGCGGCTGGTGGGCAACTCTATCCTGACCGCGATG
ATCATCTTCTGGGCCATCCCGGTCGCCGTGGTGGGCTGTATCTCCAACATCAACTTCCTAACCGAG
AAGGTCCACTTCCTGCGGTTCATTAACAACCTCCCAGACGTGCTGATGGGGCTCATCACGTCATTG
TTGCCCACGATCATGCTCGCAGTGCTAATGTCGCTCGTGCCCATTTTTATCCAGCTCGTGGCGAAC
AAGACAGGCTCGATCAGCCGCCAGGAGACGCAGCTGTACTGCCAGAGATGGTTCTACGCGTTCCAA
GTCGTGCACGTGGTGCTGGTGGTGATGCTCGCGTCTTCCGCAGCTTCGACGGTTACCGCCATCATC
GACGACCCGAACAACGCCTTCGAGCAGCTCGCGCAGAACATGCCGCTGTCCGCTAACTTCTACCTC
TCCTACGTGATGTTGTTCGCCTTCATCTTTGCTTCCGGCGTGCTGTTGCAGCTCACGGGTTTCGTC
CTGAGCTTCATCCTGGGTCGGATCCTAGACTCGACGCCCAGGCAGAAGTGGACGCGCTACAACACG
CTCAACTTGCCGACGTGGGGCGTCATGTACCCGCTCATGGAGCTGCAGGTCTGCATCATGCTCGCG
TACGCGATTGTGACACCGGTGTTGCTGATCATCAGCACGCTGGCCCTGCTGTTCGCATACGTGGCC
TACATGTACGTCTTCAACTACGTCTACGGACTGAAGCACGACTACAAGGGCAGAAACTATGTCAAC
GCGCTGTTCCAGGTCTTTGTGGGCCTCTACCTGGCCGAGGTGTTCCTGTTCGCGCTGTTCATCATG
GGCCGTGCCTGGGGCCCGCTCGTCCTTAACGTGATCATGCTGGCCTTCACCGTGCTCGTGCACCTC
TATCTCCAGCGCCGGTTCCTGCCGCTCGTCGACGCCGTGCCCCTCAGCCTCCTTGACGGCGCCGCC
GGCAGCGTCGGCAAGGACCAGGGCTGGGCCGAGGTCGTCCGCGCAGGCCGCGCGCGCCCGCTGGAC
GGCCTCGTCGCCCTCACCAACAGGCTCACCGGCGCCGCGACGCCGGCCCACCCGGCCCCCGTCAAC
CCCGACGCCGAGAAGGCCGCGCTATCCCGCTCCGCGCCCGCCGCCGCCTCATCCGCGTTGGCCCGC
GTCAAGAACTTCTTCCACCCCAGCGCCGCCTACAACTACGACCTCGCCAAGAGCAGGCTGCCCGAC
ACCTACGACAAGCCGCTCGAGTACGCCGAGGGCTACACCCGCTCCGCCTACACCGACCCCTGTATC
CGCGACAAGGAGCCCGTCCTGTGGGTCCCCGAGGACCCCATGGGCGTCGCCGCCAGGCAGGCCGCC
ATCGCCGAGCAGCACGGAGTTAAGGTCTCCACCAGCCACACCGGCTTCGACGAGAAGGGAGCTGCC
ATTTACACTGACAACCCCCCGATTACACCCCTATGACTACGTTAATCACTAG
```

SEQ ID NO: 515, protein - Ashbya gossypii
```
MADANDSSDSNSTSSFVSALILYGIIGLVYTLIFLALRKRYRRVYEPRTLDDVRTLQPSERVESAP
AGYVWWLPHLLYKPHKSLLQHMGVDAYFFARYLAVFGTLALIGCFILLPILLPVNAAGGRHLRGFE
RISFSNVAMSRRLYAHVFLSWIFFGLVLYVIYRELYYYVSMRQALQTSPYYSSLLQSRTVLFTDVR
GGTDAESVLRGAFTGVEEVVYAKDHTELRKLVKERNKTANKYESALNKVVNKSVKVRRKAELKGNT
VLQQREDLKDDDFERYVKKRPTHRLGKIPCVGEKVDTLKHCASRLGSLNSRVKSEQEEWETSQPLN
TCFVIFSTQRDAQEAYQRAPVALPKGSYDRCIIGCAPDDVNWDSLSMSKSVRRSKRLVGNSILTAM
IIFWAIPVAVVGCISNINFLTEKVHFLRFINNLPDVLMGLITSLLPTIMLAVLMSLVPIFIQLVAN
KTGSISRQETQLYCQRWFYAFQVVHVVLVVMLASSAASTVTAIIDDPNNAFEQLAQNMPLSANFYL
SYVMLFAFIFASGVLLQLTGFVLSFILGRILDSTPRQKWTRYNTLNLPTWGVMYPLMELQVCIMLA
```

FIGURE 24 (continued)

YAIVTPVLLIISTLALLFAYVAYMYVFNYVYGLKHDYKGRNYVNALFQVFVGLYLAEVFLFALFIM
GRAWGPLVLNVIMLAFTVLVHLYLQRRFLPLVDAVPLSLLDGAAGSVGKDQGWAEVVRAGRARPLD
GLVALTNRLTGAATPAHPAPVNPDAEKAALSRSAPAAASSALARVKNFFHPSAAYNYDLAKSRLPD
TYDKPLEYAEGYTRSAYTDPCIRDKEPVLWVPEDPMGVAARQAAIAEQHGVKVSTSHTGFDEKGAA
IYTDNPPDYTPYDYVNH

SEQ ID NO: 516, DNA - Kluyveromyces lactis
ATGTCTGACGCAGAGGGTGCATCATCTTCAACATCGGCATTTGTGACGACTTTGATCGTCAACGGT
GTGATCGCAACTGTATTCGTTTGGCTTTTCTTAACGTTACGTCCAAAACAACAAAGGGTGTATCAA
CCCCGGTCTTTAACGGACATCAAAACGATACCAGAGTCTGAGCGAACAGAAGAAGTCCCGTCAGGG
TATTTTGATTGGGTCCCGTATTTGCTAACAAAACCACATTCATACTTGATCCAGCATGCAAGTATC
GATGGATACTTGTTCTTGCGTTACATCTCCATTTTGGAGGTATCTCATTAATCGGTTGCTTTATA
CTTTTCCCAATTTTATTGCCGGTCAATGCTACCAATGGTTACAATCTAGAAGGGTTTGAATTGCTT
GCTTTTTCGAACGTTAGCAACAAGAATAGATTCTTTGCACATGTATTTTGTCTTGGATCTTCTTT
GGTCTAATCATCTTTATCATCTACAGAGAATTATACTATTACGTTACGCTTCGTCATTCCATTCAG
ACTTCTCCATTGTACGATGGGTTACTCTCTTCTAGAAGTATAATTTTGACCGACTTGCAGGGCGAT
TTTTGCTCTGAACCGGAGTTGAACGAAAGATTTTTGAATGTATCACAAGTTTTCCTTGCTCGTGAT
TTGAGTACCTTGCATGAATTGGTTAAGGAGCGTGCTCAACTCGCCAACAAATATGAATCTACACTA
AACGGAGTCATCACCAAATCGGTTAAGAAGAAATTAAAAGCTGATAAAAAGGGTGAAAAGGTAGCA
GAGGGAACCACTAATTTGGATCAACCTCAAAATGATTTGGAAACTTACATTCCACTGAAGAAAAGA
CCAAAGCACAGGTTATCCAAGATTCCTATATTAAATATTTGTTTGAGTGAGAAGGTTGACACATTG
GACTACTCTGTGAAACATATCAGTGAGTTGAATGAAAAAATTGGTACAGAGCAGGAAAGCTGGGAA
GATAATAACACCGTAGGATCGGCATTTATCGAATTCAAGACTCAATACGATGCGCAAAGAGCTTAT
CAATCAATCCCATATTTGTTCGATAAAGATATCTACGACAGCGCTTTAATTGGTTACGGACCAGAT
GACGTTATCTGGGAAAGCACAAGTATGAACAGGAAGACAAGAAAAGTCAAGAGATTAGGTGGTAAC
ACAATTTTAACATTGATGATCATATTTTGGGCCATTCCTGTTGCTGTGGTTGGTTGTATCTCTAAC
ATCAACTTTTTGACCGACAAGGTGCCATTTTTAAGGTTTATTGATAACATGCCTGATGTTTTGATG
GGTGTTATTACTGGTTTATTGCCAACTATTCTTTTGGCATTATTAATGTCTTTGGTTCCTGTATTC
ATTAAAAAGGTTGCTATGATGACAGGAGCTTTGACAAGGCAAGAAATTGAGCTATATTGTCACGCA
TGGTATTATGCATTCCAAGTGGTTCAAGTTTTTATAGTCGTTACTTTGGCATCTTCGGCATCCAGT
ACTGTCACAGATATCATCGATGAACCTGATTCTGCTATGACGTTGTTGGCTCAAAATTTGCCAAAG
GCTTCTAACTTCTACATCGCCTATTTCTTATTGCAAGGTTTGACTGTGCCAAGTGGAGCTTTGTTG
CAAGTTGTTGCATTGATTTTGAGTAAAGTTCTTGGAAGAGTGCTTGACAAAACACCTAGGCAAAAA
TGGGCTCGTTATAACACACTTTCTCAGCCTAGCTGGGGTGTCGTTTATCCGGTCTTAGAATTGTTG
GTATGTATCTTCATCACTTACTCTATCATTGCACCAATCATCTTGGTATTCTCTACCGTTGCACTA
GGTTTCTTCTTCCTTGCCTATTTGTACAATTTGACATATGTGATGAGCTTCAGCTATGATTTACGT
GGTAGGAACTATCCAAGAGCATTATTCCAAGTATTTGTTGGATTGTACTTAGCTGAAATATGTCTA
ATTGGTCTTTTCATCATGGCCAAGACATGGGGTCCTTTGGTTTTGGAAGCAGTCTTCTTGGCTGCT
ACTGCTCTTGCCCATATTTACTTCAAGAGAAGATTTATTCCATTGTTTGATGCAGTTCCATTGAGC
GCAATCAGATACGCTAGAGGTGAAGAAGGTTCTTATTACCCAGCCAAGGATCAAGGTTTGAACGAA
ATTCAAGTCGAAGGTAAGAAACTTGCAGAAAACATTCTATCTGAAGATAGAAATGGGGTCTTCCAA
GAAACTACAAAACAAGATTTGCAGAGAGTTAACATGCTGCCTGATGAGTATGAAGATTCTCTTGAA
AATGATTCAAAGAGCAATAATGGTAACGGAACTATTTCGGGCAGCTCGAAACAGAATCCAAGCACC
TTTGTCAACGATTCAGAACAATTCCATAAGACAAAAGTACCTCCACAAATTCCACCACCAGAAGTT
CACCAGGAAGAAAGAGACCCCAACATCATTGTCAACCGCGCGGATGCTGGGCAAGTTATCTCCGAT
GTTAAGGGTTACCCAATAAATGCACCAGAAGAGCAACTCGGTTTACCATCCGATCTGATCAGACCA
AAGAGTATCGTGGCCCGTTGCAAGCTATTCTTCCAACCTCAGAAGTACTACGATTTCGCTATTGTA

FIGURE 24 (continued)

AGGCAAACTCTACCTTATGTCTTCAATGACGTCATTAGATACGATTTGGAGTACTTGGAAACCGCC
TTCACCGAGCCTTGTGTTAGAGAGAAGGAACCAATTATATGGTGTGCAAGAGATCCTATGGGATTG
TCCCATCAGCAAATATCCATTGCATCTGCCAGTGGTGTGGATGTTAGAGATGATTTCGCTGGTTAT
GACGAGACGGGTAAGACAACATACTCTAATAGTCCTCCAGACTACGAAATGATTGCCAAAAGTGA

SEQ ID NO: 517, protein - Kluyveromyces lactis
MSDAEGASSSTSAFVTTLIVNGVIATVFVWLFLTLRPKQQRVYQPRSLTDIKTIPESERTEEVPSG
YFDWVPYLLTKPHSYLIQHASIDGYLFLRYISIFGGISLIGCFILFPILLPVNATNGYNLEGFELL
AFSNVSNKNRFFAHVFLSWIFFGLIIFIIYRELYYYVTLRHSIQTSPLYDGLLSSRSIILTDLQGD
FCSEPELNERFLNVSQVFLARDLSTLHELVKERAQLANKYESTLNGVITKSVKKKLKADKKGEKVA
EGTTNLDQPQNDLETYIPLKKRPKHRLSKIPILNICLSEKVDTLDYSVKHISELNEKIGTEQESWE
DNNTVGSAFIEFKTQYDAQRAYQSIPYLFDKDIYDSALIGYGPDDVIWESTSMNRKTRKVKRLGGN
TILTLMIIFWAIPVAVVGCISNINFLTDKVPFLRFIDNMPDVLMGVITGLLPTILLALLMSLVPVF
IKKVAMMTGALTRQEIELYCHAWYYAFQVVQVFIVVTLASSASSTVTDIIDEPDSAMTLLAQNLPK
ASNFYIAYFLLQGLTVPSGALLQVVALILSKVLGRVLDKTPRQKWARYNTLSQPSWGVVYPVLELL
VCIFITYSIIAPIILVFSTVALGFFFLAYLYNLTYVMSFSYDLRGRNYPRALFQVFVGLYLAEICL
IGLFIMAKTWGPLVLEAVFLAATALAHIYFKRRFIPLFDAVPLSAIRYARGEEGSYYPAKDQGLNE
IQVEGKKLAENILSEDRNGVFQETTKQDLQRVNMLPDEYEDSLENDSKSNNGNGTISGSSKQNPST
FVNDSEQFHKTKVPPQIPPPEVHQEERDPNIIVNRADAGQVISDVKGYPINAPEEQLGLPSDLIRP
KSIVARCKLFFQPQKYYDFAIVRQTLPYVFNDVIRYDLEYLETAFTEPCVREKEPIIWCARDPMGL
SHQQISIASASGVDVRDDFAGYDETGKTTYSNSPPDYEMIAKK

SEQ ID NO: 518, protein - DUF221 domain of SEQ ID NO: 2
LEAEQKTTLREKQQQAAIVFFNRRSAAASASQTLHAQMFDKWTVEQAPEPRQIIWSNPSKKIYERQ
IRQVVVYTIVFLTVVFYMIPITAISALTTLEKLREKLPFLKVVVDQPKIKTVLQAYLP

SEQ ID NO: 519, protein - DUF221 domain of SEQ ID NO: 4
ETDERGKIMKDPKSVVPAAFVSFRSRWGAAVCAQTQQTSNPTVWLTEWAPEPRDVYWDNLSIPFVY
LTIRRLIIAVAFFFLNFFYVLPIAFVQSLANIEGIEKAAPFLKPLIEMRTIKSFIQGFLPGIALKI
FLILLPSILMFMSKVEGLTSVSSLERRSAFKYYIFLFFNVFLGSIIAGSALEQLKTFLHQSANEIP
RTIGEAIPMKATFFITYVMVDGWAGVAGEILRLKPLIIFHLKNFFLVKTEKDREEAMDPGSIGFDS
NEPQIQLYFLLGLVYAVVTPFLLPFILIFFGLAYVVYRHQIINVYNQEYESAAAFWPSVHGRIIVA
LIVSQLLLLGLLSTKGAGQSTPVLLVLPVVTFYFYKYCKNRYEPAFVEYPLQDAMRKDTLERAREP
GFDLKGYLMNAYIHPVFK

SEQ ID NO: 520, protein - DUF221 domain of SEQ ID NO: 6
SIRLLQCENMLKRKELPVAFVSFKSQLDAAQAAEMQQHVNPLSLVTTYAPEPPDALWTNLAIPFCR
IAIYKLGVFIAAFLLIVFFTIPVTAVQGIVQFEKIKIWFPPARAVELIPGLNSVVTGYLPSMILNG
FIYLIPFAMLGMASFEGCIAKSQKEIKACNMVFYFLLGNVFFLSILSGSLLHQIGESFTHPKDIPS
RLARAVSAQSDFFITYILTDGMSGFSLEVLQFGLLTWHFFKAHSIGHSEQPYLYGFPYYRVVPIVS
LAVLIGLVYAVVAPLLLPILVIYFLLGYAVYINQMEDVYEITYDTCGQYWPNIHRYIFLSVTLMQI
TMLKSKPGASFATVPLLVSTILFNEYCKVRFLPTFLHRPVQVAKENDDLNEAEGMRGDLDHAISAY
KPP

SEQ ID NO: 521, protein - DUF221 domain of SEQ ID NO: 8
KKLVLGSRLSDYKDGRAPGAGIAFVVFKDVYTANKAVRDFRMERKKTPIGRFFPVMELQLERSRWT
VERAPPASDIYWNHLGLSKTSLGLRRIAVNTCLILMLLFFSSPLAIISGMQSAARIINVEAMDNAK
SWLVWLQSSSWFWTIIFQFLPNVLIFVSMYIIIPSVLSYFSKFECHLTVSGEQRAALLKMVCFFLV

FIGURE 24 (continued)

NLILLRALVESSLESWILSMGRCYLDSVDCKQIEQYLSPSFLSRSSLSSLAFLITCTFLGISFDLL
APIPWIKHVMKKFRKNDMVQLVPEENEDYQLMHDGEETNNLRAPLMSEREDSGILNGIEEHDLSLY
PINRSFHMPKQTFDFAQYYAFDITIFALTMIYSLFAPLTVPVGAVYFGYRYLVDKYNFLFIYRVRG
FPAGNDGKLMDMVICIMQFCVIFFLVAMLLFFAVQGDPMKLQAICTLSLLVFYKL

SEQ ID NO: 522, protein - DUF221 domain of SEQ ID NO: 10
KHDVKDSELSLPDKDCGAAFVFFKTRYAALVVSEIVQTSNPMEWVTSLAPDRDDVYWSNLWLPYKQ
LWIRRIVTLSGSIVFMFLFLIPVTFIQGLTQLEQLQQRLPFLNGILKKKYITQLVTGYLPSVILQI
FLYTVPPTMMFFSTLEGPVSHSERKRSACCKVLYFTIWNVFFVNVLSGSAISQVNALSSPKDIPMV
LARAVPVQATFFTTYVLTSGWASLSSELMQLFGLTWNFIMKYVLRMKEDSYFVPSFPYHTEVPKVL
LFGLLGFTCSVLAPLILPFLLVYFFLGYVVYRNQFLNVYCTKYDTGGLYWPIAHYTTIFSIVLTQI
ICLGVFGLKESPVAAGFTVPLIILTLLFNQYCSNRLRPLFKTLPAQDLIDMDREDEQSGRMDDIHH
RLHSAYCQFADT

SEQ ID NO: 523, protein - DUF221 domain of SEQ ID NO: 12
KPDLSDPEVIEAQKDCPGAIVFFKTRYAAIVASRILQSSNPMLWVTDFAPEPRDVYWSNLWIPYRQ
IWLRKIATLAASVAFMFVFIVPVAFVQSMMQLDQIEQLFPSLKNMLKKPFFVKLVTGYLPSVVLLL
SLYTVPPLMMFFSSIEGSISRSGRKKSACCKILFFTIWNVFFVNVLSGSVLNQLNVFTRPRDMPSM
LAELVPKQATFFITYVLTSGWASLCSEILQVYNLVYNFFRKCIFCYRDDPEYGYSFPYHTEVPKVL
LFNLLGFTFSIMAPLILPFLLVYFCLGYLVYRNQILNVYYPKYEMGGKLWPIMHSTLVFALVLTQT
IALGVFTIKHATISSGFTVLLIIGTVLFHQYCRHRFSSIFNSFSAQDLIEMDRDDEQSGRMEEIHK
HLLDAYSQGTTN

SEQ ID NO: 524, protein - DUF221 domain of SEQ ID NO: 14
EDEERHKVITDPNAIMPAAFVSFKSRWGAAVCAQTQQTSNPTLWLTEWAPEPRDVFWPNLAIPFVE
LSVRRLIMAVALFFLTFFFMIPIAIVQSMANLDDIERMLPFLKPIIERNSLKSIVQGFLPGIALKI
FLILLPTFLVMMSKIEGHTSLSGLDRRTASKYYLFLFVNVFLGSVITGTAFQQLNNFIHQSANKIP
EIVGESIPMKATFFITYVMVDGWAGVAAEVLRLKPLVMFHIKNTFLVRTERDREQAMDPGSLDFGT
TEPRIQLYFLLGLVYAVVTPILLPFIIVFFSLAYLVFRHQIINVYNQQYESGAQFWPDVQRRLVIA
LIVSQILLLGLLSTQEAEKSTVALLPLPVLSIWFHYVCKGRFEPAFIKFPLQDAMVKDTLERANDP
TLNLREYLKDAYVHPVFQ

SEQ ID NO: 525, protein - DUF221 domain of SEQ ID NO: 16
EADERQKIMKDPQSAVPAAFVSFRSRWGAAVCAQTQQTSNPTVWITEWAPEPRDVYWNNLSIPFVS
LTVRRLIVAVAFFFLNFFYVIPIAFVQSLASLEGIEKALPFLKPLIKIDVIKSFIQGFLPGIALKV
FLILLPTILMFMSKFEGLISQSSLERRSASKYYIFLFFNVFLGSIVTGSALDQLKAYIHQSANEIP
RTIGVAIPMRATFFITYVMVDGWTGVAGEILRLRALIIFHLKNFFLVKTEKDREEAMDPGSICFDW
CEPRIQLYFLLGLVYAVVTPLLLPFILVFFGLAYVVYRHQIINVYNQQYESGAQFWPSVHGRIIIA
LIVSQLLLIGLLSTKGFEETTPVLVVLPVLTFWFYKYCKNRFEPAFVRNPLQEAMRKDTLERAREP
TFDLKAYLANAYLHPVFK

SEQ ID NO: 526, protein - DUF221 domain of SEQ ID NO: 18
LEAEQKTTLREKQQQAAIVFFNRRSAAASASQTLHAQMFDKWTVEQAPEPRQIIWSNLSKKIYERQ
IRQVVVYTIVFLTVVFYMIPITAISALTTLEKLREKLPFLKVVVDQPKIKTVLQAYLPQLALIVFL
ALLPSLLMFLSKLEGIPSQGHTVRAAAGKYFYFIVFNVFLGVTISSTLFSALTTIINNPPGIVNML
ASSLPGSATFFLTFVALKFFVGYGLELSRLVPLIIFHLKRKYLCKTEDEVRAAWAPGDLGYNTRVP
NDMLIVTIVLCYSVIAPLIIPFGVAYFALGWIIVKNQVLRVYVPSYESNGRMWPHMHTRIIAALLI
YQITMVGVILLKKFLYSPVLVPLIPISFIFAYICHMRFYPAFAKTPLEVVQHNVKDTPNMDAVYTS
YIPACLKPEKLEDVD FIGURE 24 (continued)

SEQ ID NO: 527, protein - DUF221 domain of SEQ ID NO: 20
LASERQRVLNDPKAVMPVAFVTFDSRWGAAVCAQTQQSKNPTQWLTDWAPEPRDVYWQNLAIPFFS
LSIRKFLISIAVFALVFFYMIPIAFVQSLANLEGIEKVAPFLRPVIDTPVVKSFLQGFLPGLALKI
FLYILPTVLMIMSKVEGYVSLSSLERRAASKYYYFMLVNVFLGSIIAGTAFEQLNAFFHQPPSQIP
RTIGVAIPMKATFFMTYIMVDGWAGIANEILRVKPLVIYHLKNMFIVKTERDRERAMDPGSIGLAE
NLPSLQLYFLLGLVYAVVTPILLPFIIIFFAFAFLVYRHQIINVYNQEYESAAAFWPQVHSRIIAS
LLISHVTLFGLMSTMKAAYSTPLLIFLPLLTIWFHKYCKSRFEPAFRKYPLEEAMEKDNLERTSEP
NLNLKSYLQNAYLHPIFH

SEQ ID NO: 528, protein - DUF221 domain of SEQ ID NO: 22
NVRMEQSDTTRSRQEVPAAFVSFRSRYGAANAIYIRQSDKPTEWQTEHAPDPHDVYWPFFSTSFMD
RWISKFVVSVASILLILVFLLVSAFVQGLTYMEQLETWLPFLRNILEIAVVSQLVTGYLPSVILHF
LSSYVPSIMKLFSTMQGFISVSGIERSACNKMLRFTIWSVFFANVLTGSVLGQLEIFLDPKEIPKR
LAVVVPAQASFFITYVVTSWTSIASELTQTAALLFHLWGSCAKCCKRDESKPPSMHYHSEIPRVLL
FGLLGLTYFIVSPLILPFVLVYFCLGYFIYRNQLFNVYSPKYDTGGRFWPIVHGGTIFSLVLMHVI
AIGVFGLKKLPLASSLLVPLPVLTLLFNEYCRNRFLPIFEAYSTESLIKKDREEESKPEMAEFFSN
LVNAYCDPAMK

SEQ ID NO: 529, protein - DUF221 domain of SEQ ID NO: 24
KSDLQDSSLKLDDQECAAAFVYFRTRYAALVASEILQTSNPMKWVTDLAPEPDDVYWSNLWLPYKQ
LWIRRIATLLGSIVFMLFFLIPVTFIQGLSQLEQLQQRLPFLKGILEKKYMSQLVTGYLPSVILQI
FLYAVAPIMILFSTLEGPISHSERKRSACCKVLYFTVWNIFFGNVLSGTVISQLNVLSSPKDIPVQ
LARAIPVQATFFITYVLTSGWASLSSELMQLFGLIWNFVRKYILRMPEDTEFVPSFPYHTEVPKVL
LFGLLGFTCSVLAPLILPFLLVYFFLGYIVYRNQLLNVYRTRYDTGGLYWPIAHNAVIFSLVLTQI
ICLGVFGLKESPVAAGFTIPLIILTLLFNQYCRNRLLPLFRTTPAQDLIDMDREDERSGRMDEIHH
RLHSAYCQFHDT

SEQ ID NO: 530, protein - DUF221 domain of SEQ ID NO: 26
ELGELTLTTTEEERPVAFVFFKSRYDALVVSEVLQTPNPMLWVADLAPEPHDVHWRNLRIPYRQLW
MRRIATLVGAIAFMFVFLFPVTFVQGLTQLPTLSKNFPFLKDLLNRRFMEQVITGYLPSVILVLFF
YTVPPLMMYFSTLEGCVSRSQRKKSACLKILYFTIWNVFFVNILSGSVIRQFTVLNSVRDVPAQLA
KLVPAQAGFFMTYCFTSGWAGLACEIMQPVGLIWNLIAKVIVKNKEESYETLRFPYHTEIPRLLLF
GLLGFTNSVIAPLILPFLLIYFFFAYLIYKNQIINVYITKYESGGQYWPVFHNTTIFSLILSQVIA
LGFFGLKLSTVASGFTIPLILLTLLFSEYCRQRFAPIFQKYPAEILIAMDRADEMTGKMEEIHNNL
KVAYSQIPTC

SEQ ID NO: 531, protein - DUF221 domain of SEQ ID NO: 28
IMEERKKVKKDDTSVMPAAFVSFKTRWGAAVSAQTQQSSDPTEWLTEWAPEAREVFWSNLAIPYVS
LTHRRH

SEQ ID NO: 532, protein - DUF221 domain of SEQ ID NO: 30
LETEQKAVLAEKQQTAAVVFFTTRVAAASAAQSLHCQMVDKWTVTEAPEPRQLLWQNLNIKLFSRI
IRQYFIYFFVAVTILFYMIPIAFVSAITTLKNLQRIIPFIKPVVEITAIRTVLESFLPQIALIVFL
AMLPKLLLFLSKAEGIPSQSHAIRAASGKYFYFSVFNVFIGVTLAGTLFNTVKDIAKNPKLDMIIN
LLATSLPKSATFFLTYVALKFFIGYGLELSRIIPLIIFHLKKKYLCKTEAEVKEAWYPGDLSYATR
VPGDMLILTITFCYSVIAPLILIFGITYFGLGWLVLRNQALKVYVPSYESYGRMWPHIHQRILAAL
FLFQVVMFGYLGAKTFFYTALVIPLIITSLIFGYVCRQKFYGGFEHTALEVACRELKQSPDLEEIF
RAYIPHSLSSHKPEEHE

FIGURE 24 (continued)

SEQ ID NO: 533, protein - DUF221 domain of SEQ ID NO: 32
ELGELTMTTTTTEQERSAAFVFFKTRYDALVVSEVLQSSNPMLWVTDLAPEPHDVYWKNLNIPYRQ
LWIRKIATLVGAVAFMFVFLIPVTFIQGLTQLVQLSHAFPFLRGILSKNFINQVITGYLPSVILIL
FFYAVPPLMMYFSALEGCISRSIRKKSACIKVLYFTIWNVFFVNILSGSVIRQLNVFSSVRDIPAQ
LARAVPTQAGFFMTYCFTSGWASLACEIMQPMALIWNLVAKVVTKNEDESYETLRFPYHTEIPRLL
LFGLLGFTNSVIAPLILPFLLIYFFLAYLIYKNQILNVYITKYESGGQYWPIFHNTTIFSLILTQI
IALGFFGLKLSTVASGFTIPLILLTLLFSEYCRQRFAPIFNKNPAQVLIDMDRADEISGKMEELHK
KLHNVYSQIPLH

SEQ ID NO: 534, protein - DUF221 domain of SEQ ID NO: 34
IMEERKRIKKDDKSVMQAAFVSFKTRWGAAVCAQTQQTKNPTEWLTEWAPEAREMYWPNLAMPYVS
LTVRRFVMHIAFFFLTFFFIIPIAFVQSLASIEGIEKSAPFLSPIVKNKLMKSLIQGFLPGIVLKL
FLIFLPTILMIMSKFEGFISISSLERRAAFRYYIFNLVNVFLGSVITGSAFEQLDSFLKQSANDIP
RTVGVAIPIKATFFITYIMVDGWAGVAGEIFRLKPLVIFHLKNFFFVKTEKDREEAMDPGQIDFYA
TEPRIQLYFLLGLVYAPVTPVLLPFIIFFFGFAYLVFRHQKYESAGAFWPDVHGRIISALIISQIL
LLGLMSTKGKVQSTPFLLVLAILTFGFHRFCKGRYESAFVINPLQEAMIKDTLERAREPNLNLKGF
LQNAYVHPVFK

SEQ ID NO: 535, protein - DUF221 domain of SEQ ID NO: 36
NIRLGQAEVSAPGKEVRAAFVSFKSRYGAATALHMPQSINPTYWLTEPAPEPHDVHWPFFSASFMQ
KWLAKILVVFACLLLTILFLVPVVLVQGLTNLPALEFMFPFLSLILSMKVVSQIITGYLPSLILQT
SLKVVPPTMEFLSSIQGHICHSDIQKSACNKVIWFTIWNVFFATVFSGSAFYKLSVILDPKQIPLK
LAVAVPAQASFFIAYVVTTGWTDTLTELFRVVPFMVSYIKRSFEPSDENEFVVPPMRYHRDTPRVL
FFGLLGITYFFLAPLILPFILLYFILAYIIYRNQFMNVYAPKFDTGGMFWPMIHYTMIFSLVLMQA
IAIGLFALKKMELATYLLVPLPVFTLLFNEFCRKRFMPIFTDYPAEVLTKRDKEDRNDPTMPEFYN
NLVSAYKDPALL

SEQ ID NO: 536, protein - DUF221 domain of SEQ ID NO: 38
DMRLKQSLLAGEEVPAAFVSFRTRHGAAIATNIQQGIDPTQWLTEAAPEPEDVHWPFFTASFVRRW
ISNVVVLVAFVALLILYIVPVVLVQGLANLHQLETWFPFLKGILNMKIVSQVITGYLPSLIFQLFL
LIVPPIMLLLSSMQGFISHSQIEKSACIKLLIFTVWNSFFANVLSGSALYRVNVFLEPKTIPRVLA
AAVPAQASFFVSYVVTSGWTGLSSEILRLVPLLWSFITKLFGKEDDKEFEVPSTPFCQEIPRILFF
GLLGITYFFLSPLILPFLLVYYCLGYIIYRNQVTEPISLLSIILC

SEQ ID NO: 537, protein - DUF221 domain of SEQ ID NO: 40
ISEEKETVMSSTKSLVPAAFVSFKKRWGAVVCSQTQQSRNPTEWLTEWAPEPRDIYWDNLALPYVQ
LTIRRLVIAVAFFFLTFFFMIPIAFVQTLANIEGIEKAVPFLKPLIEVKTVKSFIQGFLPGIALKI
FLIVLPSILMLMSKFEGFISKSSLERRCASRYYMFQFINVFLCSIIAGTALQQLDSFLNQSATEIP
KTIGVSIPMKATFFITYIMVDGWAGVAGEILRLKPLIIYHLKNFFLVKTEKDREEAMDPGTIGFNT
GEPQIQLYFILGLVYAAVSPILLPFILVFFALAYVVYRHQIINVYNQEYESAAAFWPDVHRRVVIA
LIVSQLLLMGLLSTKKAARSTPLLFILPVLTIGFHKFCQGRYQPIFVTYPLQDAMVKDTLERMREP
NLNLKTFLQNAYAHPVFK

SEQ ID NO: 538, protein - DUF221 domain of SEQ ID NO: 42
MIYHLQSETMLREKELPVAFVTFKSRRNAALAAQTQQHSNPLELITEMAPEPRDVSWRNLAIPQKI
LPLNKIGVILAAALLTIFFAIPVTAVQGIAKYEKLKKWFPPAMAIEFIPGLSSVVTGYLPSAILKG
FMYIIPFAMLGLAYLGGSISNSKEEIKACNMVFYFLMGNVFFLSLISGSLLDEIGEYLTHPRDIPS

FIGURE 24 (continued)

HLAAAVSAQAEFFMTYILTDGLSGFSLEILQLGLILFDIIRSYTYGRGKERTPYLFSFPYFRVIPT
VSLSIMIGMIYAVVAPLMLPFLVGYFCLGYIVYFNQMEDVYETTYDTCGRFWPFIHHYIFVSIILM
QITMVGLFGLKSKPSAAIATVPLILITIAYNEYCKIRFLPSFKHFPIQTAVEIDEEDEKNGEMETH
YVDAATAYNRHQPC

SEQ ID NO: 539, protein - DUF221 domain of SEQ ID NO: 44
MSLERQKVLKDSKLMLPVAFVSFDSRWGAAVCAQTQQSKNPTLWLTSSAPEPRDIYWQNLAIPFIS
LTIRKLVIGVSVFALVFFYMIPIAFVQSLANLEGLDRVAPFLRPVTRLDFIKSFLQGFLPGLALKI
FLWILPTVLLIMSKIEGYIALSTLERRAAAKYYYFMLVNVFLGSIIAGTAFEQLHSFLHQSPSQIP
RTIGVSIPMKATFFITYIMVDGWAGIAGEILRLKPLVIFHLKNMFIVKTEEDRVRAMDPGFVDFKE
TIPSLQLYFLLGIVYTAVTPILLPFILIFFAFAYLVYRHQIINVYNQQYESCGAFWPHVGRIIAS
LLISQLLLMGLLASKKAADSTPLLIILPILTLSFHKYCKHRFEPAFRQYPLEEAMAKDKLEKETEP
ELNMKADLADAYLHPIFH

SEQ ID NO: 540, protein - DUF221 domain of SEQ ID NO: 46
IAEERENVVNDQKSVMPASFVSFKTRWAAAVCAQTTQTRNPTEWLTEWAAEPRDIYWPNLAIPYVS
LTVRRLVMNVAFFFLTFFFIIPIAFVQSLATIEGIEKVAPFLKVIIEKDFIKSLIQGLLAGIALKL
FLIFLPAILMTMSKFEGFTSVSFLERRSASRYYIFNLVNVFLGSVIAGAAFEQLNSFLNQSPNQIP
KTIGMAIPMKATFFITYIMVDGWAGVAGEILMLKPLIIYHLKNAFLVKTEKDREEAMNPGSIGFNT
GEPQIQLYFLLGLVYAPVTPMLLPFILVFFALAYVVYRHQIINVYNQEYESAAAFWPDVHGRVITA
LIISQLLLMGLLGTKHAASAAPFLIALPVITIGFHRFCKGRFEPAFVRYPLQEAMMKDTLERAREP
NLNLKGYLQDAYIHPVFK

SEQ ID NO: 541, protein - DUF221 domain of SEQ ID NO: 48
ISEEKQRLRTGTKSIVPAAFVSFKSRWGAAVCAQTQQTRNPTEWLTEWAAEPRDIYYDNLALPYVD
LKIRRLIVGVAYFFLTFFFMIPIAFVQSLANIEGIEKAFPFLKPLIEVKLLKSIIQGFLPGIALKI
FLLFLPRILMQMSKFEGFVSTSSLERRAATRFYMFQFINVFLGSIVTGTAFQQLNSFLNQSANDIP
KTIGVSIPMKATFFITYIMVDGWAGVAGEILRLKPLIIYHLKNSFLVRTEKDREEATDPGTIGFNT
GEPQIQLYFLLGLVYAAVSPILLPFILVFFGLAFVVYRHQVINVYNQKYESAGKFWPDVHRRVVTA
LVVSQLLLMGLLSTKHASKSTPLLLVLPLLTIGFHKHCKNRYQPAFVTYPLQQEAMIKDTLDRIRE
PNLNLKAFLRDAYAHPEFR

SEQ ID NO: 542, protein - DUF221 domain of SEQ ID NO: 50
ISKEREEVVNDPKAIMPAAFVSFKTRWAAAVCAQTQQTRNPTQWLTEWAPEPRDVFWSNLAIPYVS
LTVRRLIMHVAFFFLTFFFIVPIAFVQSLATIEGIVKAAPFLKFIVDDKFMKSVIQGFLPGIALKL
FLAFLPSILMIMSKFEGFTSISSLERRAAFRYYIFNLVNVFLASVIAGAAFEQLNSFLNQSANQIP
KTIGVAIPMKATFFITYIMVDGWAGVAGEILMLKPLIMFHLKNAFLVKTDKDREEAMDPGSIGFNT
GEPRIQLYFLLGLVYAPVTPMLLPFILVFFALAYIVYRHQIINVYNQEYESAAAFWPDVHGRVIAA
LVISQLLLMGLLGTKHAALAAPFLIALPVLTIGFHHFCKGRYEPAFIRYPLQEAMMKDTLETAREP
NLNLKGYLQNAYVHPVFK

SEQ ID NO: 543, protein - DUF221 domain of SEQ ID NO: 52
LRADLESQLAAYKEGRAQGAGVAFVMFKDVYTANKAVQDFRNERSRRTGKFFSVTELRLQRNQWKV
DRAPLATDIYWNHLGLTKVALIVRRVIVNTILLLILVFFSSPLALISALVSAGRIFNAEALDSAQY
WLTWVQTSGWIGSLIFQFLPNVFIFVSMYIVIPSALSYLSKFERHLTVSGEQRAALLKMVCFFLVN
LIILKALVESSLESALLKMSRCYLDGEDCKRIEEYMSPSFLSRSCVSALAFLITSTFLGISFDLLA
PIPWIKKKIQKFRKNDMLQLVPEQNEEYALENQEPSSNLETPLLPENMFESPRFGDIEPMSQDLSE
YPISRTSPIPKQKFDFAQYYAFNLTIFALTMIYSSFAPLVVPVGAVYFGYRYIVDKYNFLYVYRVR
GFPAGNEGKLMDTVLCIMRFCVDLYLVSMLLFFSVKGDSTKLQAIFTLGVLVMYKL

FIGURE 24 (continued)

SEQ ID NO: 544, protein - DUF221 domain - consensus sequence
IXXERXXVLXDXXXXXXXXXVPAAFVSFKSRWGAAVAAQTQQTXNPXXXXXXXXXXXXXXXXXXTXWL
TEXAPEPRDVYWXNLAIPYVXLXIRRLVVXVAXFXLMFFFMIPIAFVQSLAXXXXXXXNLEXLEKXX
PFLKXILXXXXIKSVIXGFLPXXIILXIFLXILPXILMXMSKLEGXISXSXLERXAXXKXYXFXLX
NVFLGSVLSGSALXQLXXFLXXXXXXXSXXXDIPXXLAXAIPXXXATFFITYVMXXGWAGVAXEIL
XLXPLIIXHLKXXFLXKTEXXXXXAXDPXSIXYXTXIPXIXLYXLLGLXYAVVAPLLLPFILVYFX
LAYLVYRXQIINVXXXXYXXXYESGGXFWPXVHXXIIXALILSQILLLGLXXXKXAXXATXXLIXL
XVLTIXFXXYCKXRFXPXFXXYPLQXEXMXXDXXEXXXXXXXXLXXXLXXAYXXXXXX where X can be any naturally occurring amino acid

SEQ ID NO: 545, protein - motif 1
AP(E/D/R)P(R/H/E/N)(Q/D/A)(I/V/A)XW where X can be any naturally occurring amino acid

SEQ ID NO: 546, DNA - primer 1
GGGGACAAGTTTGTACAAAAAAGCAGGCTTAAACAATGGACACCGCGTCGT

SEQ ID NO: 547, DNA - primer 2
GGGGACCACTTTGTACAAGAAAGCTGGGTCAGCACTTGCATTAGATGGAT

SEQ ID NO: 548, DNA - Oryza sativa
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTTATTATTTATCTTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTTCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAAGGGGATCTGTATCTGTGATGATTCC
TGTTCTTGGATTTGGGATAGAGGGGTTCTTGATGTTGCATGTTATCGGTTCGGTTTGATTAGTAGT
ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA

```
AACAGTTATAATCCTCAGGAACAGGGGATTCCCTGTTCTTCCGATTTGCTTTAGTCCCAGAATTTT
TTTTCCCAAATATCTTAAAAAGTCACTTTCTGGTTCAGTTCAATGAATTGATTGCTACAAATAATG
CTTTTATAGCGTTATCCTAGCTGTAGTTCAGTTAATAGGTAATACCCCTATAGTTTAGTCAGGAGA
AGAACTTATCCGATTTCTGATCTCCATTTTTAATTATATGAAATGAACTGTAGCATAAGCAGTATT
CATTTGGATTATTTTTTTATTAGCTCTCACCCCTTCATTATTCTGAGCTGAAAGTCTGGCATGAA
CTGTCCTCAATTTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTC
```

SEQ ID NO: 549, DNA - Expression cassette
```
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTATTATTTATCTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTCCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTTCGATCCATATCTTCCGGTCGAGTTCTTGG
TCGATCTCTTCCCTCCTCCACCTCCTCCTCACAGGGTATGTGCCCTTCGGTTGTTCTTGGATTTAT
TGTTCTAGGTTGTGTAGTACGGGCGTTGATGTTAGGAAAGGGGATCTGTATCTGTGATGATTCCTG
TTCTTGGATTTGGGATAGAGGGGGTTCTTGATGTTGCATGTTATCGGTTCGGTTTGATTAGTAGTAT
GGTTTTCAATCGTCTGGAGAGCTCTATGGAAATGAAATGGTTTAGGGTACGGAATCTTGCGATTTT
GTGAGTACCTTTTGTTTGAGGTAAAATCAGAGCACCGGTGATTTTGCTTGGTGTAATAAAAGTACG
GTTGTTTGGTCCTCGATTCTGGTAGTGATGCTTCTCGATTTGACGAAGCTATCCTTTGTTTATTCC
CTATTGAACAAAAATAATCCAACTTTGAAGACGGTCCCGTTGATGAGATTGAATGATTGATTCTTA
AGCCTGTCCAAAATTTCGCAGCTGGCTTGTTTAGATACAGTAGTCCCCATCACGAAATTCATGGAA
ACAGTTATAATCCTCAGGAACAGGGGATTCCCTGTTCTTCCGATTTGCTTTAGTCCCAGAATTTTT
TTTCCCAAATATCTTAAAAAGTCACTTTCTGGTTCAGTTCAATGAATTGATTGCTACAAATAATGC
TTTTATAGCGTTATCCTAGCTGTAGTTCAGTTAATAGGTAATACCCCTATAGTTTAGTCAGGAGAA
GAACTTATCCGATTTCTGATCTCCATTTTTAATTATATGAAATGAACTGTAGCATAAGCAGTATTC
ATTTGGATTATTTTTTTATTAGCTCTCACCCCTTCATTATTCTGAGCTGAAAGTCTGGCATGAAC
TGTCCTCAATTTTGTTTTCAAATTCACATCGATTATCTATGCATTATCCTCTTGTATCTACCTGTA
GAAGTTTCTTTTTGGTTATTCCTTGACTGCTTGATTACAGAAAGAAATTTATGAAGCTGTAATCGG
GATAGTTATACTGCTTGTTCTTATGATTCATTTCCTTTGTGCAGTTCTTGGTGTAGCTTGCCACTT
TCACCAGCAAAGTTCATTTAAATCAACTAGGGATATCACAAGTTTGTACAAAAAAGCAGGCTTAAA
CAATGGACACCGCGTCGTTCGTGACGTCGCTGCTGACGTCGTTCGTGATCTTCGTCGTGCTGGTGC
TGGTGTTCACGTGGCTGTCGAGCAGGCCGGGCAATGCGCCGGTGTACTACCCGAGCGTCCTGCTGC
GGGGGCTCGACCCGTGGGAGGGGCGGGGGCGGGGACGAGGAGCCCCGTCGGGTGGCTGCGCCAGG
```

FIGURE 24 (continued)

```
CGATCTCCGCCTCGGAGGGTGACGTCGTCGCCGTCGGCGGGGTCGACGCCGCCGTCTACCTCGTCT
TCCTCTCCTCCGTGTTGTCCATCTTGGTGTTCTCTGGGATTGTGCTGCTTCCAGTTCTGCTACCTG
TTGCTGCTACTGACGATAACCTGAACCTGGAGAGGGCCATTGGCCTGAAGAACGGCAAAACACCCC
AGAACTTCACAGAGCTCGAGAAATTAGCACTGGGCAATGTTCAAGAACATAGCCGAAGGCTGTGGG
CATTTCTATTATCAGTCTATTGGGTCTCTTTTGTCACGTACTTCGTACTATGGAAGTCCTACAAGC
ATGTTTCTAATATGAGAGCGGCTGCAAGATCAACACCAGATGTTAAACCGGAGGAGTTTGCTGTGT
TGGTGAGAGATGTTCCTAAGCCACCTCCTGATCAAACTATAAAGGATTCTGTAGACTCATATTTCC
GAGCACTTCATCCTGATACCTTCTACAGATCAATGGTTGTGACTGACCACACAAAGGCTGACAAAA
TTTATCAAGAGATTGAAGGTCACAAACAGAAAATTGCTCGTGCTGAAGTTGTCTATGCGGAGTCTA
AAACAACAGGCAAGCCTGAGGGCACCAAGCCTACGCATCGGATTGGATTTCTTGGTCTTATCGGTA
AAAAGGTTGATACAATTGAGTATTGTAATGACCAAATCAAGGAGTTGCTGCCCAAACTGGAGGCCG
AACAGAAGACTACCCTTCGTGAGAAACAGCAACAGGCTGCAATTGTGTTTTTCAACAGAAGATCTG
CTGCAGCTTCTGCATCTCAGACTCTCCATGCTCAGATGTTTGATAAATGGACTGTTGAGCAGGCTC
CTGAACCACGCCAGATAATATGGTCTAATCCTTCCAAGAAAATATATGAGAGGCAAATCAGACAGG
TTGTGGTCTATACCATTGTCTTTCTCACAGTGGTTTTCTATATGATTCCTATTACTGCTATCTCTG
CTCTTACAACTTTGGAGAAGTTGAGGGAGAAGCTTCCCTTTCTGAAGGTGGTGGTGGACCAACCGA
AAATCAAGACTGTCCTACAGGCTTACCTCCCGTAG
```

FIGURE 24 (continued)

PLANTS HAVING INCREASED YIELD-RELATED TRAITS BY EXPRESSING A GROWTH-REGULATING FACTOR (GRF) POLYPEPTIDE AND METHOD FOR MAKING THE SAME

RELATED APPLICATIONS

This application is a national stage application (under 35 U.S.C. §371) of PCT/EP2008/062232, filed Sep. 15, 2008, which claims benefit of European application 07116515.3, filed Sep. 14, 2007, European Application 07116520.3, filed Sep. 14, 2007, European Application 07116516.1, filed Sep. 14, 2007, European Application 07116961.9, filed Sep. 21, 2007, European Application 07117490.8, filed Sep. 28, 2007, U.S. Provisional Application 60/975,877, filed Sep. 28, 2007, U.S. Provisional Application 60/975,900, filed Sep. 28, 2007, U.S. Provisional Application 60/975,887, filed Sep. 28, 2007, U.S. Provisional Application 60/976,835, filed Oct. 2, 2007 and U.S. Provisional Application 60/977,121, filed Oct. 3, 2007.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Second_Revised_Sequence_List_13311_00065_US. The size of the text file is 1,426 KB, and the text file was created on Nov. 18, 2010.

The present invention relates generally to the field of molecular biology and concerns a method for increasing various plant yield-related traits by increasing expression in a plant of a nucleic acid sequence encoding a polypeptide selected from the group consisting of: GRF polypeptide, RAA1-like polypeptide, SYR polypeptide, ARKL polypeptide, and YTP polypeptide. The present invention also concerns plants having increased expression of a nucleic acid sequence encoding a polypeptide selected from the group consisting of: GRF polypeptide, RAA1-like polypeptide, SYR polypeptide, ARKL polypeptide, and YTP polypeptide, which plants have increased yield-related traits relative to control plants. The invention also provides constructs useful in the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Plant biomass is yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage. These allometric relationships are used to extrapolate from one of these measures of size to another (e.g. Tittonell et al 2005 Agric Ecosys & Environ 105: 213). Plant size at an early developmental stage will typically correlate with plant size later in development. A larger plant with a greater leaf area can typically absorb more light and carbon dioxide than a smaller plant and therefore will likely gain a greater weight during the same period (Fasoula & Tollenaar 2005 Maydica 50:39). This is in addition to the potential continuation of the micro-environmental or genetic advantage that the plant had to achieve the larger size initially. There is a strong genetic component to plant size and growth rate (e.g. ter Steege et al 2005 Plant Physiology 139:1078), and so for a range of diverse genotypes plant size under one environmental condition is likely to correlate with size under another (Hittalmani et al 2003 Theoretical Applied Genetics 107:679). In this way a standard environment is used as a proxy for the diverse and dynamic environments encountered at different locations and times by crops in the field.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (*Zea mays* L.) hybrids based on Corn Belt germplasm in the European Atlantic.

Harvest index, the ratio of seed yield to aboveground dry weight, is relatively stable under many environmental conditions and so a robust correlation between plant size and grain yield can often be obtained (e.g. Rebetzke et al 2002 Crop Science 42:739). These processes are intrinsically linked because the majority of grain biomass is dependent on current or stored photosynthetic productivity by the leaves and stem of the plant (Gardener et al 1985 Physiology of Crop Plants. Iowa State University Press, pp 68-73). Therefore, selecting for plant size, even at early stages of development, has been used as an indicator for future potential yield (e.g. Tittonell et al 2005 Agric Ecosys & Environ 105: 213). When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

Another trait of importance is that of improved abiotic stress tolerance. Abiotic stress is a primary cause of crop loss worldwide, reducing average yields for most major crop plants by more than 50% (Wang et al. (2003) Planta 218: 1-14). Abiotic stresses may be caused by drought, salinity, extremes of temperature, chemical toxicity, excess or deficiency of nutrients (macroelements and/or microelements), radiation and oxidative stress. The ability to increase plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors. Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increase yield-related traits (seed yield and/or biomass) in plants may be through modification of the inherent growth mechanisms of a plant, such as the cell cycle or various signalling pathways involved in plant growth or in defense mechanisms.

It has now been found that various yield-related traits may be increased in plants relative to control plants, by increasing expression in a plant of a nucleic acid sequence encoding a Growth-Regulating Factor (GRF) polypeptide. The increased yield-related traits comprise one or more of: increased early vigour, increased aboveground biomass, increased total seed yield per plant, increased seed filling rate, increased harvest index and increased thousand kernel weight.

It has now been found that various growth characteristics may be improved in plants by modulating expression in a plant of a nucleic acid encoding a RAA1-like (Root Architecture Associated 1) in a plant.

It has now been found that various growth characteristics, in particular increased abiotic stress resistance, may be improved in plants by modulating expression in a plant of a nucleic acid encoding a Seed Yield Regulator (SYR) protein.

It has now been found that various yield-related traits may be improved in plants by modulating expression in a plant of a nucleic acid encoding an ARKL (ARADIA Like) polypeptide in a plant.

It has now been found that various yield-related traits may be improved in plants by modulating expression in a plant of a nucleic acid encoding a YTP (Yield Transmembrane Protein) in a plant.

BACKGROUND

DNA-binding proteins are proteins that comprise any of many DNA-binding domains and thus have a specific or general affinity to DNA. DNA-binding proteins include for example transcription factors that modulate the process of transcription, nucleases that cleave DNA molecules, and histones that are involved in DNA packaging in the cell nucleus.

Transcription factors are usually defined as proteins that show sequence-specific DNA binding affinity and that are capable of activating and/or repressing transcription. The *Arabidopsis thaliana* genome codes for at least 1533 transcriptional regulators, accounting for ~5.9% of its estimated total number of genes (Riechmann et al. (2000) Science 290: 2105-2109). The Database of Rice Transcription Factors (DRTF) is a collection of known and predicted transcription factors of *Oryza sativa* L. ssp. *indica* and *Oryza sativa* L. ssp. *japonica*, and currently contains 2,025 putative transcription factors (TF) gene models in *indica* and 2,384 in *japonica*, distributed in 63 families (Gao et al. (2006) Bioinformatics 2006, 22(10):1286-7).

One of these families is the Growth-Regulating Factor (GRF) family of transcription factors, which is specific to plants. At least nine GRF polypeptides have been identified in *Arabidopsis thaliana* (Kim et al. (2003) Plant J 36: 94-104), and at least twelve in *Oryza sativa* (Choi et al. (2004) Plant Cell Physiol 45(7): 897-904). The GRF polypeptides are characterized by the presence in their N-terminal half of at least two highly conserved domains, named after the most conserved amino acids within each domain: (i) a QLQ domain (InterPro accession IPR014978, PFAM accession PF08880), where the most conserved amino acids of the domain are Gln-Leu-Gln; and (ii) a WRC domain (InterPro accession IPR014977, PFAM accession PF08879), where the most conserved amino acids of the domain are Trp-Arg-Cys. The WRC domain further contains two distinctive structural features, namely, the WRC domain is enriched in basic amino acids Lys and Arg, and further comprises three Cys and one His residues in a conserved spacing ($CX_9CX_{10}CX_2H$), designated as the Effector of Transcription (ET) domain (Ellerstrom et al. (2005) Plant Molec Biol 59: 663-681). The conserved spacing of cysteine and histidine residues in the ET domain is reminiscent of zinc finger (zinc-binding) proteins. In addition, a nuclear localisation signal (NLS) is usually comprised in the GRF polypeptide sequences.

Interaction of some GRF polypeptides with a small family of transcriptional coactivators, GRF-interacting factors (GIF1 to GIF3; also called synovial sarcoma translocation (SYT) polypeptide, SYT1 to SYT3), has been demonstrated using a yeast two-hybrid interaction assay (Kim & Kende (2004) Proc Natl Acad Sci 101: 13374-13379).

The name GRF has also been given to another type of polypeptides, belonging to the 14-3-3 family of polypeptides (de Vetten & Ferl (1994) Plant Physiol 106: 1593-1604), that are totally unrelated the GRF polypeptides useful in performing the methods of the invention.

Transgenic *Arabidopsis thaliana* plants transformed with a rice GRF (OsGRF1) polypeptide under the control of a viral constitutive 35S CaMV promoter displayed curly leaves, severely reduced elongation of the primary inflorescence, and delayed bolting (van der Knapp et al. (2000) Plant Physiol 122: 695-704). Transgenic *Arabidopsis thaliana* plants transformed with either one of two *Arabidopsis* GRF polypeptides (AtGRF1 and AtGRF2) developed larger leaves and cotyledons, were delayed in bolting, and were partially sterile (due to lack of viable pollen), compared to wild type plants (Kim et al. (2003) Plant J 36: 94-104).

In US patent application US2006/0048240, an *Arabidopsis thaliana* GRF polypeptide is identified as SEQ ID NO: 33421. In US patent application US 2007/0022495, an *Arabidopsis thaliana* GRF polypeptide is identified as SEQ ID NO: 1803 (also therein referred to as G1438). Transgenic *Arabidopsis* plants overexpressing G1438 using the 35S CaMV promoter present dark green leaves.

Surprisingly, it has now been found that increasing expression of a nucleic acid sequence encoding a GRF polypeptide gives plants having increased yield-related traits relative to control plants.

According to one embodiment, there is provided a method for increasing yield-related traits in plants relative to control plants, comprising increasing expression of a nucleic acid sequence encoding a GRF polypeptide in a plant. The increased yield-related traits comprise one or more of: increased early vigour, increased aboveground biomass, increased total seed yield per plant, increased seed filling rate, increased harvest index and increased thousand kernel weight.

Little is known about the molecular biology of root formation in monocotyledonous plants. So far only a few genes have been identified that affect root development: examples are the rt1 mutant which forms few or no crowns and brace roots (Jenkins, J. Hered. 21: 79-80, 1930), the asr1 mutant, which displays defective seminal roots (De Miranda et al., Maize Genet. Coop. News Lett. 54: 18-19, 1980), the rtcs mutant lacking nodal (adventitious) roots (Hetz et al., Plant J. 10: 845-857, 1996), the slr1 mutant and slr2 mutant with shortened lateral roots (Hochholdinger et al., Plant Physiol 125:1529-1539, 2001), or rum1, which is affected in lateral initiation in the primary root but also in the initiation of seminal root formation (Woll et al., Plant Physiol., 139, 1255-1267, 2005). Liu et al. (Proteomics 6, 4300-4308, 2006) made a proteomic comparison between primary roots of wild-type and rum1 seedlings and identified another 12 genes that were differently regulated and which were involved in lignin biosynthesis, defence, and the citrate cycle.

Another gene involved in root formation in monocotyledonous plants is raa1, first isolated from rice (Ge et al., Plant Physiol. 135, 1502-1513, 2004): the gene encodes a 12.0-kD protein having 58% homology to the *Arabidopsis* FPF1 (Flowering Promoting Factor 1). In rice, RAA1 was expressed specifically in the apical meristem, the elongation zone of root tip, steles of the branch zone, and the young lateral root. Constitutive overexpression increased the number of adventitious roots, but primary root growth was decreased. In addition, the endogenous auxin content was increased. OsRAA1 was also induced by auxin; suggesting that a positive feedback regulation exists between RAA1 and auxin in rice root development (Ge et al., 2004). Furthermore, plants overexpressing OsRAA1 had longer leaves and sterile florets (Ge et al., 2004). WO 2006/067219 discloses the use of FPF1 and related proteins for increasing the production of carbohydrates in plants, but transgenics overexpressing FPF1 did not show increased seed yield and no effects on root growth were reported.

Surprisingly, it has now been found that modulating expression of a nucleic acid encoding a RAA1-like polypeptide gives plants having enhanced yield-related traits, in particular increased yield relative to control plants.

According one embodiment, there is provided a method for improving yield related traits of a plant relative to control plants, comprising modulating expression of a nucleic acid encoding a RAA1-like polypeptide in a plant. The improved yield related traits comprised increased height, shoot/root index, root thickness, greenness index, number of flowers per panicle and increased thousand kernel weight. Improved yield related traits were observed under normal growth conditions as well as under stress conditions.

Seed Yield Regulator (SYR) is a new protein that hitherto has not been characterised. SYR shows some homology (around 48% sequence identity on DNA level, around 45% at protein level) to an *Arabidopsis* protein named ARGOS (Hu et al., Plant Cell 15, 1951-1961, 2003; US 2005/0108793). Hu et al. postulated that ARGOS is a protein of unique function and is encoded by a single gene. The major phenotypes of ARGOS overexpression in *Arabidopsis* are increased leafy biomass and delayed flowering. In contrast, overexpression of SYR in rice primarily increases seed yield, whereas the leafy biomass and flowering time are not obviously affected.

Surprisingly, it has now been found that modulating expression in a plant of a nucleic acid encoding a Seed Yield Regulator protein (hereafter named SYR) gives plants, when grown under abiotic stress conditions, having enhanced abiotic stress tolerance relative to control plants.

Therefore, the present invention provides a method for enhancing yield-related traits in plants grown under abiotic stress conditions, relative to control plants, comprising modulating expression in a plant of a nucleic acid encoding a SYR polypeptide.

ARKL polypeptides comprise a RING finger domain which resembles that found in the mouse protein ARKADIA, an E3 ubiquitin ligase involved in Nodal signaling during embryogenesis (Mavrakis et al. 2007; PLoS Biol. 2007 March; 5(3):e67).

Ubiquitilytion, a process by which a protein is modified the by covalent attachment of ubiquitin is a central and essential part of various cellular processes in eukaryotes. In plants, defects in this pathway cause numerous development aberrations, altered response to external stimuli and modify cell cycle and growth patterns. Ubiquitinated proteins are targeted for degradation via a 26S proteasome dependent or independent pathway. Ubiquitin modification plays a role in activation of signalling proteins, endocytosis, sorting, and histone modification.

The fate of the ubiquitinated protein is determined by the nature of the ubiquitin linkage. Single or multiple ubiquitins may be attached to the target (mono and poly ubiquitination; the specific Lys residue used to form the ubiquitin chain can influence the final fate of the modified protein, for example whether that is degradation or activation The attachment of ubiquitin to proteins occurs in a multistep process involving three enzymes called, E1, E2, E3 (Glikcman and Ciechanover (2000) Physiol Rev 82: 377-482). Initially the ubiquin is linked to protein in an ATP dependent manner which is then transferred to a cystein acceptor in the E2 protein to form a E2-ubiquitin intermediate which acts as a ubiquitin donor to the target protein in a reaction mediated by the ubiquitin ligase, also called E3 ligase or E3 enzyme. There are multiple types of E3 ligases. The RING-type E3 ligases are characterized by the presence of a conserved protein domain called RING finger or RING-ZnF (Really Interesting New Gene-Zinc Finger).

Zinc-binding motifs are stable structures, and they rarely undergo conformational changes upon binding their target. Most ZnF proteins contain multiple finger-like protrusions that make tandem contacts with their target molecule, often recognising extended substrates. The RING finger is a specialized Zinc biding domain which peresumably functions in protein—protein interactions. The RING finger is 40 to 60 residues long and coordinates two zinc atoms. It is distinct from other zinc fingers in that the eight metal ligand amino acid residues that coordinate the zinc ion fall into a specific structure called the cross-brace structure (Borden (2000). J Mol Biol 295: 1103-1112). The spacing of the cysteines/histidines coordinating the Zinc ions in such a domain is C-x(2)-C-x(9 to 39)-C-x(1 to 3)-H-x(2 to 3)-C-x(2)-C-x(4 to 48)-C-x(2)-C. Metal ligand pairs one and three co-ordinate to bind one zinc ion, whilst pairs two and four bind the second. There are two different variants, the C3HC4-type and a C3H2C3-type, which is clearly related despite the different cysteine/histidine pattern. The latter type is sometimes referred to as 'RING-H2 finger'. In the latter the coordination of the Zinc ion is mediated by 6 cysteins and 2 histidines whilst in the C3HC4 is mediated by 7 cysteins and one histidine.

In *Arabidopsis thaliana* there are at least 477 putative RING domain comprising proteins. Some contain multiple RING finger domains. The RING domains have been classified into eight types based on of the metal ligand residue present and/or the number of amino acids between them (Stone at al. 2005) Plant Phys. 137, 13-30. The RING-H2 class is the largest class in *Arabidopsis*. Based on the nature of the domains and their organisation the *Arabidopsis* RING finger proteins have been further classified in 30 groups, Group 1 to Group 30. Subgroups within some of the groups were also recognized, eg. subgroup 2.1 and 2.2 of group 2 (Stone et al. 2005). Group I was referred to as group of RING finger protein lacking previously described domains. Sequence analysis of those protein revealed regions of similarity between a few proteins outside of the RING domain, which were called DAR1 to DAR3 (Domain Associated with RING). DAR1 and DAR3 are approximately 40 amino acids long and DAR2 120. DAR1 was reported to occur only in proteins of plant origin (Stone et al. 2005). The presence of common conserved domains suggested a related function for the proteins comprising the domains.

Surprisingly, it has now been found that modulating expression of a nucleic acid encoding an ARKL polypeptide gives plants having enhanced yield-related traits in particular increased yield relative to control plants.

According one embodiment, there is provided a method for improving or enhancing yield related traits of a plant relative to control plants, comprising modulating expression of a nucleic acid encoding an ARKL polypeptide in a plant.

All eukaryotic cells contain elaborate systems of internal membranes which set up various membrane-enclosed compartments within the cell. The endomembrane system is collection of membranous structures involved in transport within the cell. The main components of the endomembrane system are the endoplasmic reticulum, Golgi bodies, vesicles, cell membrane and nuclear envelope. Members of the endomembrane system pass materials through each other or though the use of vesicles. A universal feature of all cells is an outer limiting membrane called the plasma membrane.

Cell membranes are built from lipids and proteins. The association of proteins to the membrane may be via a covalent bond, by which the protein is attached to the lipids of the membrane. In the case of the so called transmembrane proteins, polypeptide chains of the protein actually traverse the lipid bilayer. Association to the membrane may also occur via association of the protein, so called peripherial protein, by non-covalent bonds to the protruding portions of integral membrane proteins.

Transmembrane proteins (TM proteins) have an amphiphilic nature with hydrophobic TM segments (TMSs) and hydrophilic loops. In transmembrane proteins, the portion within the lipid bilayer consists primarily of hydrophobic amino acids. These are usually arranged in an alpha helix so that the polar carboxi (—C=O) and amino (—NH) groups at the peptide bonds can interact with each other rather than with their hydrophobic surroundings. Those portions of the polypeptide that project out from the bilayer tend to have a high percentage of hydrophilic amino acids. Furthermore, those that project into the extracellular space are usually glycosilated.

Transmembrane topology of a protein has been determined based on experimental X-ray crystallography, NMR, gene fusion technique, substituted cysteine accessibility method, Asp(N)-linked glycosylation experiment and other biochemical methods. In addition a number transmembrane topology prediction methods have been developed to determine the structure and function of TM proteins from their amino acid sequences (Möller et al., 2001; Ikeda et al., 2002; Chen et al., 2002).

The analysis of protein sequence similarity between proteins has benefited from developments in the genomics field. A number of domains conserved amongst two or more proteins for which no function has yet been assigned can be carried out using specific algorithms. One such conserved domain is the so called DUF221 domain (Domain of Unknown Function 221) as described in Pfam (Finn et al. Nucleic Acids Research (2006) Database Issue 34:D247-D251). This domain is found in a family of hypothetical transmembrane proteins, none of which have any known function, the aligned region is at 538 residues at maximum length. The domain occurs in a number of proteins of eukaryotic origin. Expression of an *Arabidopsis* gene, EDR4, encoding a protein comprising a DUF221 has been reported to be expressed shortly upon dehydration treatment (Kiyosue et al; Plant Mol Biol. 1994 25(5):791-8). An *Arabidopsis* knockout mutant, gfs10, in a gene encoding another DUF221 domain-containing protein has been reported to have a phenotype similar to that of vacuolar sorting mutants (Fuji et al; 2007. Plant Cell. 2007. 19(2): 597-609).

Surprisingly, it has now been found that modulating expression of a nucleic acid encoding a YTP polypeptide gives plants having enhanced yield-related traits in particular increased yield relative to control plants.

According one embodiment, there is provided a method for enhancing (improving) yield related traits of a plant relative to control plants, comprising modulating expression of a nucleic acid encoding a YTP polypeptide in a plant.

DEFINITIONS

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

Homoloque(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions | Residue | Conservative Substitutions |
|---|---|---|---|
| Ala | Ser | Leu | Ile; Val |
| Arg | Lys | Lys | Arg; Gln |
| Asn | Gln; His | Met | Leu; Ile |
| Asp | Glu | Phe | Met; Leu; Tyr |

TABLE 1-continued

Examples of conserved amino acid substitutions

| Residue | Conservative Substitutions | Residue | Conservative Substitutions |
|---|---|---|---|
| Gln | Asn | Ser | Thr; Gly |
| Cys | Ser | Thr | Ser; Val |
| Glu | Asp | Trp | Tyr |
| Gly | Pro | Tyr | Trp; Phe |
| His | Asn; Gln | Val | Ile; Leu |
| Ile | Leu, Val | | |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein.

Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Ortholoque(s)/Paraloque(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

Motif/Consensus Sequence/Signature

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Hybridisation

The term "hybridisation" as defined herein is a process wherein substantially homologous complementary nucleotide sequences anneal to each other. The hybridisation process can occur entirely in solution, i.e. both complementary nucleic acid molecules are in solution. The hybridisation process can also occur with one of the complementary nucleic acid molecules immobilised to a matrix such as magnetic beads, Sepharose beads or any other resin. The hybridisation process can furthermore occur with one of the complementary nucleic acid molecules immobilised to a solid support such as a nitro-cellulose or nylon membrane or immobilised by e.g. photolithography to, for example, a siliceous glass support (the latter known as nucleic acid sequence arrays or microarrays or as nucleic acid sequence chips). In order to allow hybridisation to occur, the nucleic acid molecules are generally thermally or chemically denatured to melt a double strand into two single strands and/or to remove hairpins or other secondary structures from single stranded nucleic acid molecules.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acid sequences may deviate in sequence and still encode a substantially identical polypeptide, due to the degeneracy of the genetic code. Therefore medium stringency hybridisation conditions may sometimes be needed to identify such nucleic acid sequence molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid sequence strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m = 81.5° \text{ C.} + 16.6 \times \log_{10}[Na^+]^a + 0.41 \times \%[G/C^b] - 500 \times [L^c]^{-1} - 0.61 \times \% \text{ formamide}$$

2) DNA-RNA or RNA-RNA hybrids:

$$Tm = 79.8 + 18.5(\log_{10}[Na^+]^a) + 0.58 (\% G/C^b) + 11.8 (\% G/C^b)^2 - 820/L^c$$

3) oligo-DNA or oligo-RNA$^d$ hybrids:
For <20 nucleotides: $T_m = 2 (l_n)$
For 20-35 nucleotides: $T_m = 22 + 1.46 (l_n)$ $^a$ or for other monovalent cation, but only accurate in the 0.01-0.4 M range.
$^b$ only accurate for % GC in the 30% to 75% range.
$^c$ L=length of duplex in base pairs.
$^d$ oligo, oligonucleotide; $I_n$=effective length of primer=2× (no. of G/C)+(no. of NT).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid sequence hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acid molecules of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, $3^{rd}$ Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Gene Shuffling/Directed Evolution

Gene shuffling or directed evolution consists of iterations of DNA shuffling followed by appropriate screening and/or selection to generate variants of nucleic acid sequences or portions thereof encoding proteins having a modified biological activity (Castle et al., (2004) Science 304(5674): 1151-4; U.S. Pat. Nos. 5,811,238 and 6,395,547).

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid sequence control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, increasers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or increases expression of a nucleic acid sequence molecule in a cell, tissue or organ.

A "plant promoter" comprises regulatory elements, which mediate the expression of a coding sequence segment in plant cells. Accordingly, a plant promoter need not be of plant origin, but may originate from viruses or microorganisms, for example from viruses which attack plant cells. The "plant promoter" preferably originates from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid sequence molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid sequence used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about $\frac{1}{10,000}$ transcripts to about $\frac{1}{100,000}$ transcripts, to about $\frac{1}{500,0000}$ transcripts per cell. Conversely, a "strong promoter" drives expression of a coding sequence at high level, or at about $\frac{1}{10}$ transcripts to about $\frac{1}{100}$ transcripts to about $\frac{1}{1000}$ transcripts per cell. Generally, by "medium strength promoter" is intended a promoter that drives expression of a coding sequence at a level that is in all instances below that obtained under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of plant constitutive promoters

| Gene Source | Reference |
| --- | --- |
| Actin | McElroy et al, Plant Cell, 2: 163-171, 1990 |
| HMGB | WO 2004/070039 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| V-ATPase | WO 01/14572 |
| G-box proteins | WO 94/12015 |
| CAMV 35S | Odell et al, Nature, 313: 810-812, 1985 |
| CaMV 19S | Nilsson et al., Physiol. Plant. 100: 456-462, 1997 |
| 34S FMV | Sanger et al., Plant. Mol. Biol., 14, 1990: 433-443 |
| nos | Shaw et al. (1984) Nucleic Acids Res. 12(20): 7831-7846 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
| --- | --- |
| Rice RCc3 | Xu et al (1995) Plant Mol Biol 27(2): 237-48 |
| *Arabidopsis* phosphate transporter PHT1 | Kovama et al., 2005 |
| *Medicago* phosphate transporter | Xiao et al., 2006 |
| *Arabidopsis* Pyk10 | Nitz et al. (2001) Plant Sci 161(2): 337-346 |
| Tobacco root-specific genes RB7, RD2, RD5, RH12 | Conkling et al. (1990) Plant Phys 93(3): 1203-1211 |
| Barley root-specific lectin | Lerner & Raikhel (1989) Plant Phys 91: 124-129 |
| Root-specific hydroxy-proline rich protein | Keller & Lamb (1989) Genes & Dev 3: 1639-1646 |
| *Arabidopsis* CDC27B/hobbit | Blilou et al. (2002) Genes & Dev 16: 2566-2575 |

A seed-specific promoter is transcriptionally active predominantly in seed tissue, but not necessarily exclusively in seed tissue (in cases of leaky expression). The seed-specific promoter may be active during seed development and/or during germination. Examples of seed-specific promoters are shown in Table 2c below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
| --- | --- |
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| Legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| Zein | Matzke et al Plant Mol Biol, 14(3): 323-32 1990 |
| NapA | Stalberg et al, Planta 199: 515-519, 1996. |
| Wheat LMW and HMW glutenin-1 | Mol Gen Genet 216: 81-90, 1989; NAR 17: 461-2, 1989 |
| Wheat SPA | Albani et al, Plant Cell, 9: 171-184, 1997 |
| Wheat α, β, γ-gliadins | EMBO J. 3: 1409-15, 1984 |

TABLE 2c-continued

Examples of seed-specific promoters

| Gene source | Reference |
| --- | --- |
| Barley Itr1 promoter | Diaz et al. (1995) Mol Gen Genet 248(5): 592-8 |
| Barley B1, C, D, hordein | Theor Appl Gen 98: 1253-62, 1999; Plant J 4: 343-55, 1993; Mol Gen Genet 250: 750-60, 1996 |
| Barley DOF | Mena et al, The Plant Journal, 116(1): 53-62, 1998 |
| blz2 | EP99106056.7 |
| Synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| Maize ESR gene family | Plant J 12: 235-46, 1997 |
| *Sorghum* α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | Unpublished |
| PRO0147, trypsin inhibitor ITR1 (barley) | Unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| Cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2d below.

TABLE 2d

Examples of green tissue-specific promoters

| Gene | Expression | Reference |
| --- | --- | --- |
| Maize Orthophosphate dikinase | Leaf specific | Fukayama et al., 2001 |
| Maize Phosphoenolpyruvate carboxylase | Leaf specific | Kausch et al., 2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of meristem-specific promoters which may be used to perform the methods of the invention are shown in Table 2e below.

TABLE 2e

Examples of meristem-specific promoters

| Gene source | Expression pattern | Reference |
| --- | --- | --- |
| rice OSH1 | Shoot apical meristem, from embryo globular stage to seedling stage | Sato et al. (1996) Proc. Natl. Acad. Sci. USA, 93: 8117-8122 |
| Rice metallothionein WAK1 & WAK 2 | Meristem specific Shoot and root apical meristems, and in expanding leaves and sepals | BAD87835.1 Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565, 350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene.

The isolated gene may be isolated from an organism or may be manmade, for example by chemical synthesis.

Decreased Expression

Reference herein to "decreased epression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid sequence encoding the protein of interest (target gene), or from any nucleic acid sequence capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

This reduction or substantial elimination of expression may be achieved using routine tools and techniques. A method for the reduction or substantial elimination of endogenous gene expression is by RNA-mediated silencing using an inverted repeat of a nucleic acid sequence or a part thereof (in this case a stretch of substantially contiguous nucleotides derived from the gene of interest, or from any nucleic acid sequence capable of encoding an orthologue, paralogue or homologue of the protein of interest), preferably capable of forming a hairpin structure. Another example of an RNA silencing method involves the introduction of nucleic acid sequences or parts thereof (in this case a stretch of substantially contiguous nucleotides derived from the gene of interest, or from any nucleic acid sequence capable of encoding an orthologue, paralogue or homologue of the protein of interest) in a sense orientation into a plant. Another example of an RNA silencing method involves the use of antisense nucleic acid sequences. Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682). Other methods, such as the use of antibodies directed to an endogenous polypeptide for inhibiting its function in planta, or interference in the signalling pathway in which a polypeptide is involved, will be well known to the skilled man. Artificial and/or natural microRNAs (miRNAs) may be used to knock out gene expression and/or mRNA translation. Endogenous miRNAs are single stranded small RNAs of typically 19-24 nucleotides long.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. MiRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs (Schwab et al., (2005) Dev Cell 8(4):517-27). Convenient tools for design and generation of amiRNAs and their precursors are also available to the public (Schwab et al., (2006) Plant Cell 18(5):1121-33).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid sequence to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid sequence construct of the invention. These marker genes enable the identification of a successful transfer of the nucleic acid sequence molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acid sequences into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid sequence molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid sequence can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acid sequences have been introduced successfully, the process according to the invention for introducing the nucleic acid sequences advantageously employs techniques which enable the removal or excision of these marker genes. One such a method is what is known as co-transformation. The co-transformation method employs two vectors simultaneously for the transformation, one vector bearing the nucleic acid sequence according to the invention and a second bearing the marker gene(s). A large proportion of transformants receives or, in the case of plants, comprises (up to 40% or more of the transformants), both vectors. In case of transformation with Agrobacteria, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid sequence (known as the Ac/Ds technology). The transformants can be crossed with a transposase source or the transformants are transformed with a nucleic acid sequence construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or
(b) genetic control sequence(s) which is operably linked with the nucleic acid sequence according to the invention, for example a promoter, or
(c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acid sequences used in the method of the invention are not at their natural locus in the genome of said plant, it being possible for the nucleic acid sequences to be expressed homologously or heterologously. However, as mentioned, transgenic also means that, while the nucleic acid sequence according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acid sequences according to the invention at an unnatural locus in the genome, i.e. homologous or, preferably, heterologous expression of the nucleic acid sequences takes place. Preferred transgenic plants are mentioned herein.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acid sequences or the construct to be expressed is preferably cloned into a vector, which is suitable for transforming *Agrobacterium tumefaciens*, for example pBin19 (Bevan et al., Nucl. Acids Res. 12 (1984) 8711). Agrobacteria transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic [Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

T-DNA Activation Tagging

T-DNA activation tagging (Hayashi et al. Science (1992) 1350-1353), involves insertion of T-DNA, usually containing a promoter (may also be a translation increaser or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through Agrobacterium infection and leads to modified expression of genes near the inserted T-DNA. The resulting transgenic plants show dominant phenotypes due to modified expression of genes close to the introduced promoter.

TILLING

The term "TILLING" is an abbreviation of "Targeted Induced Local Lesions In Genomes" and refers to a mutagenesis technology useful to generate and/or identify nucleic acid sequences encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in Arabidopsis Research, Koncz C, Chua N H, Schell J, eds. Singapore, World Scientific Publishing Co, pp. 16-82; Feldmann et al., (1994) In Meyerowitz E M, Somerville C R, eds, Arabidopsis. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet 5(2): 145-50).

Homologous Recombination

Homologous recombination allows introduction in a genome of a selected nucleic acid sequence at a defined selected position. Homologous recombination is a standard technology used routinely in biological sciences for lower organisms such as yeast or the moss Physcomitrella. Methods for performing homologous recombination in plants have been described not only for model plants (Offring a et al. (1990) EMBO J 9(10): 3077-84) but also for crop plants, for example rice (Terada et al. (2002) Nat Biotech 20(10): 1030-4; lida and Terada (2004) Curr Opin Biotech 15(2): 132-8), and approaches exist that are generally applicable regardless of the target organism (Miller et al, Nature Biotechnol. 25, 778-785, 2007).

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant may relate to vegetative biomass (root and/or shoot biomass), to reproductive organs, and/or to propagules (such as seeds) of that plant.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increase/Improve/Enhance

The terms "increase", "improve" or "increase" are interchangeable and shall mean in the sense of the application at least a 5%, 6%, 7%, 8%, 9%, or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per hectare or acre; b) increased number of flowers per panicle and/or per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; f) increased number of primary panicles; (g) increased thousand kernel weight (TKW), which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in yield may also manifest itself as an increase in seed area and/or seed length and/or seed width and/or seed perimeter. Increased seed yield may also result in modified architecture, or may occur because of modified architecture.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid sequence of interest. The term "plant" also encompasses plant cells, suspension cultures, callus tissue, embryos, meristematic regions, gametophytes, sporophytes, pollen and microspores, again wherein each of the aforementioned comprises the gene/nucleic acid sequence of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elate*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp., *Pinus* spp., *Pistacia vera*, *Pisum* spp., *Poa* spp., *Populus* spp., *Prosopis* spp., *Prunus* spp., *Psidium* spp., *Punica granatum*, *Pyrus communis*, *Quercus* spp., *Raphanus sativus*, *Rheum rhabarbarum*, *Ribes* spp., *Ricinus communis*, *Rubus* spp., *Saccharum* spp., *Salix* sp., *Sambucus* spp., *Secale cereale*, *Sesamum* spp., *Sinapis* sp., *Solanum* spp. (e.g. *Solanum tuberosum*, *Solanum integrifolium* or *Solanum lycopersicum*), *Sorghum bicolor*, *Spinacia* spp., *Syzygium* spp., *Tagetes* spp., *Tamarindus indica*, *Theobroma cacao*, *Trifolium* spp., *Triticale* sp., *Triticosecale rimpaui*, *Triticum* spp. (e.g. *Triticum aestivum*, *Triticum durum*, *Triticum turgidum*, *Triticum hybernum*, *Triticum macha*, *Triticum sativum* or *Triticum vulgare*), *Tropaeolum minus*, *Tropaeolum majus*, *Vaccinium* spp., *Vicia* spp., *Vigna* spp., *Viola odorata*, *Vitis* spp., *Zea mays*, *Zizania palustris*, *Ziziphus* spp., amongst others.

DETAILED DESCRIPTION OF THE INVENTION

Surprisingly, it has now been found that increasing expression in a plant of a nucleic acid sequence encoding a GRF polypeptide gives plants having increased yield-related traits relative to control plants. According to a first embodiment, the present invention provides a method for increasing yield-related traits in plants relative to control plants, comprising increasing expression in a plant of a nucleic acid sequence encoding a GRF polypeptide.

A preferred method for increasing expression of a nucleic acid sequence encoding a GRF polypeptide is by introducing and expressing in a plant a nucleic acid sequence encoding a GRF polypeptide.

Any reference hereinafter to a "protein useful in the methods of the invention" is taken to mean in one embodiment a GRF polypeptide as defined herein. Any reference hereinafter to a "nucleic acid sequence useful in the methods of the invention" is taken to mean a nucleic acid sequence capable of encoding such a GRF polypeptide. The nucleic acid sequence to be introduced into a plant (and therefore useful in performing the methods of the invention) is any nucleic acid sequence encoding the type of polypeptide, which will now be described, hereafter also named "GRF nucleic acid sequence" or "GRF gene".

A "GRF polypeptide" as defined herein refers to any polypeptide comprising: (i) a domain having at least 50%, 55%, 60%, 65%, 70%, 75%, 80%, 85%, 90%, 95%, 98%, 99% or more amino acid sequence identity to a QLQ domain as represented by SEQ ID NO: 115; and (ii) a domain having at least 50%, 55%, 60%, 65%, 70%, 75%, 80%, 85%, 90%, 95%, 98%, 99% or more amino acid sequence identity to a WRC domain as represented by SEQ ID NO: 116.

Alternatively or additionally, a "GRF polypeptide" as defined herein refers to any polypeptide comprising: (i) a QLQ domain with an InterPro accession IPR014978 (PFAM accession PF08880); (ii) a WRC domain with an InterPro accession IPR014977 (PFAM accession PF08879); and (iii) an Effector of Transcription (ET) domain comprising three Cys and one His residues in a conserved spacing ($CX_9CX_{10}CX_2H$).

Alternatively or additionally, a "GRF polypeptide" as defined herein refers to any polypeptide having in increasing order of preference at least 50%, 55%, 60%, 65%, 70%, 75%, 80%, 85%, 90%, 95%, 98%, 99% or more amino acid sequence identity to the GRF polypeptide as represented by SEQ ID NO: 2 or to any of the full length polypeptide sequences given in Table A herein.

Alternatively or additionally, a "GRF polypeptide" interacts with GRF-interacting factor (GIF) polypeptides (also called synovial sarcoma translocation (SYT) polypeptides) in a yeast two-hybrid interaction assay.

Surprisingly, it has now been found that modulating expression in a plant of a nucleic acid encoding a RAA1-like polypeptide gives plants having enhanced yield-related traits relative to control plants. According to a first embodiment, the present invention provides a method for enhancing yield-related traits in plants relative to control plants, comprising modulating expression in a plant of a nucleic acid encoding a RAA1-like polypeptide.

A preferred method for modulating (preferably, increasing) expression of a nucleic acid encoding a RAA1-like polypeptide is by introducing and expressing in a plant a nucleic acid encoding a RAA1-like polypeptide.

Any reference hereinafter to a "protein useful in the methods of the invention" is taken to mean in one embodiment a RAA1-like polypeptide as defined herein. Any reference hereinafter to a "nucleic acid useful in the methods of the invention" is taken to mean a nucleic acid capable of encoding such a RAA1-like polypeptide. The nucleic acid to be introduced into a plant (and therefore useful in performing the methods of the invention) is any nucleic acid encoding the type of protein which will now be described, hereafter also named "RAA1-like nucleic acid" or "RAA1-like gene".

A "RAA1-like polypeptide" as defined herein refers to any polypeptide represented by SEQ ID NO: 121 and to orthologues and paralogues thereof. RAA1-like proteins are small (MW between 10 and 21 kDA) and basic polypeptides (pI above 8.5), and usually have zero or one Cys residue in the sequence that aligns with SEQ ID NO: 121 when using a standard Needleman-Wunsch alignment program with default settings.

Preferably, the RAA1-like polypeptide comprises two or more of the following conserved sequence motifs:

```
                               SEQ ID NO: 162
    motif 1:   GVW(V/L)F,

SEQ ID NO: 163
    motif 2:   LGW(E/S)RY(Y/F),

SEQ ID NO: 164
    motif 3:   (D/H)L(L/I)S(I/V/L)P(R/K/A)(S/D)F,

SEQ ID NO: 165
    motif 4:   (H/Y)(F/M)YD(V/I)VVK(N/T)(R/P),
```

Alternatively, the homologue of a RAA1 protein has in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 121, provided that the homologous protein comprises the conserved motifs 1 (a, b, c or d), 2 and 3, and the leucine rich domain as outlined above. The overall sequence identity is determined using a global alignment algorithm, such as the Needleman Wunsch algorithm in the program GAP (GCG Wisconsin Package, Accelrys), preferably with default parameters.

Preferably, the polypeptide sequence which when used in the construction of a phylogenetic tree, such as the one depicted in FIG. 8 (Ge et al., 2004), clusters with the group of RAA1-like polypeptides comprising the amino acid sequence represented by SEQ ID NO: 121 rather than with any other group.

Surprisingly, it has now been found that modulating expression in a plant of a nucleic acid encoding a SYR polypeptide gives plants, when grown under abiotic stress conditions, having enhanced yield-related traits relative to control plants. According to a first embodiment, the present invention provides a method for enhancing yield-related traits in plants grown under abiotic stress conditions, relative to control plants, comprising modulating expression in a plant of a nucleic acid encoding a SYR polypeptide.

A preferred method for modulating (preferably, increasing) expression of a nucleic acid encoding a SYR polypeptide is by introducing and expressing in a plant a nucleic acid encoding a SYR polypeptide.

Any reference hereinafter to a "protein useful in the methods of the invention" is taken to mean in one embodiment a SYR polypeptide as defined herein. Any reference hereinafter to a "nucleic acid useful in the methods of the invention" is taken to mean a nucleic acid capable of encoding such a SYR polypeptide. The nucleic acid to be introduced into a plant (and therefore useful in performing the methods of the invention) is any nucleic acid encoding the type of protein which will now be described, hereafter also named "SYR nucleic acid" or "SYR gene".

The term "SYR protein or homologue thereof" as defined herein refers to a polypeptide of about 65 to about 200 amino acids, comprising (i) a leucine rich domain that resembles a leucine zipper in the C-terminal half of the protein, which leucine rich domain is (ii) preceded by a tripeptide with the sequence YFS (conserved motif 5a, SEQ ID NO: 173), or YFT (conserved motif 5b, SEQ ID NO: 174), or YFG (conserved motif 5c, SEQ ID NO: 175) or YLG (conserved motif 5d, SEQ ID NO: 176), and (iii) followed by a conserved motif 6 ((V/A/I)LAFMP(T/S), SEQ ID NO: 177). Preferably, the conserved motif 6 is (AN)LAFMP(T/S) (SEQ ID NO: 177), most preferably, the conserved motif is VLAFMPT (SEQ ID NO: 177). The "SYR protein or homologue thereof" preferably also has a conserved C-terminal peptide ending with the conserved motif 7 (SYL or PYL, SEQ ID NO: 178). The leucine rich domain of the SYR protein or its homologue is about 38 to 48 amino acids long, starting immediately behind the conserved motif 5 and stopping immediately before the conserved motif 6, and comprises at least 30% of leucine. The Leu rich domain preferably has a motif that resembles the Leucine Zipper motif (L-X6-L-X6-L-X6-L, wherein X6 is a sequence of 6 consecutive amino acids). A preferred example of a SYR protein is represented by SEQ ID NO: 169, an overview of its domains is given in FIG. 11.

Further preferably, SYR proteins have two transmembrane domains, with the N-terminal part and C-terminal part of the protein located inside and the part between the transmembrane domains located outside.

Alternatively, the homologue of a SYR protein has in increasing order of preference at least 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 169, provided that the homologous protein comprises the conserved motifs 5(a, b, c or d), 6 and 7, and the leucine rich domain as outlined above. The overall sequence identity is determined using a global alignment algorithm, such as the Needleman Wunsch algorithm in the program GAP (GCG Wisconsin Package, Accelrys), preferably with default parameters. Compared to overall sequence identity, the sequence identity will generally be higher when only conserved domains or motifs are considered.

Surprisingly, it has now been found that modulating expression in a plant of a nucleic acid encoding an ARKL polypeptide gives plants having enhanced yield-related traits relative to control plants. According to a first embodiment, the present invention provides a method for enhancing yield-related traits in plants relative to control plants, comprising modulating expression in a plant of a nucleic acid encoding an ARKL polypeptide.

A preferred method for modulating (preferably, increasing) expression of a nucleic acid encoding an ARKL polypeptide is by introducing and expressing in a plant a nucleic acid encoding an ARKL polypeptide.

Any reference hereinafter to a "protein useful in the methods of the invention" is taken to mean an ARKL polypeptide as defined herein. Any reference hereinafter to a "nucleic acid useful in the methods of the invention" is taken to mean a nucleic acid capable of encoding such an ARKL polypeptide. The nucleic acid to be introduced into a plant (and therefore useful in performing the methods of the invention) is any nucleic acid encoding the type of protein which will now be described, hereafter also named "ARKL nucleic acid" or "ARKL gene".

An "ARKL polypeptide" as defined herein refers to any polypeptide comprising a conserved domain of the zinc finger RING-type and optionally a DAR1 domain. The RING-type zinc finger found in ARKL polypeptide comprises a canonical C3H2C3 zinc finger domain type. It can further be classified into the RING-H2 type within group I as defined by Stone et al. 2005.

A consensus sequence representing the RING-H2 domain has been reported as represented by CX(2)CX(9-39)CX(1-3)HX(2-3)HX(2)CX(4-48)CX(2)C (SEQ ID NO: 400). The length of the variable loops in ARKL polypeptides is typically of 14-15 amino acids between metal ligands 2 and 3 and of 10 amino acids between metal ligands 6 and 7 (FIG. 1). Specific amino acid residues other than those implicated in the direct coordination of Zn2+ ions are highly conserved in the RING-H2 domain of ARKL polypeptides (FIG. 1). SEQ ID NO: 401 represents a consensus sequence conserved amongst the majority of ARKL polypeptides.

A preferred ARKL polypeptide useful in the methods of the invention refers to a polypeptide comprising a ZfC3H2C3 zinc finger RING domain, such domain being represented by SEQ ID NO: 400 or a polypeptide having in increasing order of preference at least 50%, 55%, 60%, 65%, 70%, 75%, 80%, 85%, 90%, 95% or more sequence identity to one or more of the ZfC3H2C3 domains as represented by SEQ ID NO: 306 to SEQ ID NO: 351. Further preferably the ARKL polypeptide of the invention comprises a ZfC3H2C3 domain as represented by SEQ ID NO: 401.

ARKL polypeptides typically comprise an additional domain, named DAR1 (Domain Associated with RING), which has been previously described to occur outside of the RING domain in a few RING proteins of plant origin (Stone et al. 2005). DAR1 domain is typically found at the N-terminus of the RING domain. Typically DAR1 domains comprise a conserved amino acid signature as represented by SEQ ID NO: 399 (Motif 8).

A further preferred ARKL polypeptide useful in the methods of the invention refers to a polypeptide comprising a DAR1 domain having in increasing order of preference at least 50%, 55%, 60%, 65%, 70%, 75%, 80%, 85%, 90%, 95% or more sequence identity to one or more of the DAR1 domains as represented by SEQ ID NO: 352 to SEQ ID NO. 398. Still more preferably the ARKL polypeptide of the invention comprises Motif 8 as represented by SEQ ID NO: 399.

Zinc finger RING-type and DAR1 domains can be found in protein databases specialized in protein families, domains and functional sites such as Pfam (Finn et al. Nucleic Acids Research (2006) Database Issue 34:D247-D251) or InterPro which integrates the protein signature databases: PROSITE, PRINTS, ProDom, Pfam, SMART, TIGRFAMs, PIRSF, SUPERFAMILY, Gene3D and PANTHER (Mulder et al. 2007 Nucleic Acids Research, 2007, Vol. 35, Database issue D224-D228). Pfam compiles a large collection of multiple sequence alignments and hidden Markov models (HMM) covering many common protein domains and families and is available through the Sanger Institute in the United Kingdom. Trusted matches as considered in the Pfam database are those sequences scoring higher than the gathering cut-off threshold. The gathering cutoff threshold of the RING-H2 domain (Pfam accession number: PF00097) in the Pfam HMM_fs method is 16.0 and in the Pfam HMM_Is method is 15.2. However potential matches, comprising true RING-H2 domain domains, may still fall under the gathering cut-off. Preferably an ARKL polypeptide useful in the methods of the invention is a protein having one or more domains in their sequence that exceed the gathering cutoff of the Pfam protein domain family PF000097, also known as Zinc finger, C3HC4 type (RING finger) family domain.

Alternatively, Zinc finger RING-type and DAR1 domains in a polypeptide may be identified by performing a sequence comparison with known polypeptides comprising a Zinc finger RING-type and/or DAR1 domains and establishing the similarity in the region of said domains. The sequences may be aligned using any of the methods well known in the art such as Blast algorithms. The probability for the alignment to occur with a given sequence is taken as basis for identifying similar polypeptides. A parameter that is typically used to represent such probability is called e-value. The E-value is a measure of the reliability of the S score. The S score is a measure of the similarity of the query to the sequence shown. The e-value describes how often a given S score is expected to occur at random. The e-value cut-off may be as high as 1.0. The typical threshold for a trusted e-value from a BLAST search output using an ARKL polypeptide as query sequence is lower than e$^{-5}$(=10-5), 1.e-10, 1.e-15, 1.e-20, 1.e-25, 1.e-50, 1.e-75, 1.e-100, 1.e-200, 1.e-300, 1.e-400, 1.e-500, 1.e-600, 1.e-700 and 1.e-800. Preferably ARKL polypeptides useful in the methods of the invention comprise a sequence having in increasing order of preference an e-value lower than e$^{-5}$(=10-5), 1.e-10, 1.e-15, 1.e-20, 1.e-25, 1.e-50, 1.e-75, 1.e-100, 1.e-200, 1.e-300, 1.e-400, 1.e-500, 1.e-600, 1.e-700 and 1.e-800 in an alignment with a Zinc finger RING-type and/or DAR1 domains as found in a known ARKL polypeptides, such as for example SEQ ID NO: 213.

Examples of ARKL polypeptides useful in the methods of the invention are given in Table A. A sequence comprising the RING-H2 and DAR1 domains as present in the representative ARKL polypeptides of Table A is given in SEQ ID NO: 306 to SEQ ID NO: 351 and SEQ ID NO: 352 to SEQ ID NO: 398, respectively. The amino acid coordinates of the position of RING-H2 and DAR1 domains as present in a selection of ARKL polypeptides of Table A are given in Example 4.

Further preferred ARKL polypeptides useful in the methods of the invention are those having in increasing order of preference at least 50%, 55%, 60%, 65%, 70%, 75%, 80%, 85%, 90%, 95%, 96%; 98% or more sequence identity to any of the polypeptides given in Table A.

Surprisingly, it has now been found that modulating expression in a plant of a nucleic acid encoding a YTP polypeptide gives plants having enhanced yield-related traits relative to control plants. According to a first embodiment, the present invention provides a method for enhancing yield-related traits in plants relative to control plants, comprising modulating expression in a plant of a nucleic acid encoding a YTP polypeptide.

A preferred method for modulating (preferably, increasing) expression of a nucleic acid encoding a YTP polypeptide is by introducing and expressing in a plant a nucleic acid encoding a YTP polypeptide.

Any reference hereinafter to a "protein useful in the methods of the invention" is taken to mean in one embodiment a YTP polypeptide as defined herein. Any reference hereinafter to a "nucleic acid useful in the methods of the invention" is taken to mean a nucleic acid capable of encoding such a YTP polypeptide. The nucleic acid to be introduced into a plant (and therefore useful in performing the methods of the invention) is any nucleic acid encoding the type of protein which will now be described, hereafter also named "YTP nucleic acid" or "YTP gene".

A "YTP polypeptide" as defined herein refers to a polypeptide comprising at least one transmembrane domain and a portion of at least 50 contiguous amino acids of a DUF221 domain. Additionally the YTP polypeptide may comprise Motif 9 as represented by SEQ ID NO: 546.

Transmembrane proteins have an amphiphilic structure with hydrophobic segments traversing the membranes and hydrophilic loops that may be located at either side of the membrane (see FIG. 20). Loops are the segments (regions) of a protein located between two TM domains. Average sized loops located on the inside side of the membrane are typically more negatively charged than those on the outside of the membrane.

A transmembrane domain forms a secondary structure (usually an alpha or beta helix) of typically 12-35 amino acid residues. The loops between the transmembrane domains are typically shorter than 60 amino acid residues, though long globular regions may also occur. The number of transmembrane domains in a YTP polypeptide is variable, but typically between 2 and 20.

The transmembrane domain found in YTP polypeptides is preferably between 8 and 50 amino acids, most preferably 8, 12, 14, 16, 18, 2, 22, 24, 26, 28, 30, 32, 34, 35, or 36 amino acids. A loop found in YTP polypeptides has preferably above 20, 25, 30, 35, 40, 45, 50, 55, 60, 65, 70, 75, 80, 85, 90, 100 amino acid residues.

A preferred YTP polypeptide useful in the methods of the invention comprises in increasing order of preference more than 1, 2, 4, 5, 6, 8, 10, 12 transmembrane domains.

Transmembrane domains are highly hydrophobic proteins rich in non-polar amino acids. Table 3 shows a classification of the amino acids according to the side chain properties. Hydrophobic amino acids are indicated. The hydrophobic character of a peptide can be determined by methods well known in the art, as for example reported by Kyte and Doolittle (1982) J. Mol. Biol., 157:105-132.

YTP polypeptides useful in the methods of the invention preferably comprise transmembrane domains having at least 20%, 30%, 40%, 50%, 60%, or more non-polar amino acids. Table 3 gives the polarity of the 20 essential amino acids.

TABLE 3

Classification of amino acids according to the side chain properties.

| Amino Acid | 3-Letter | 1-Letter | Side chain polarity | Side chain acidity or basicity | Hydropathy index |
|---|---|---|---|---|---|
| Arginine | Arg | R | polar | basic | −4.5 |
| Asparagine | Asn | N | polar | neutral | −3.5 |
| Aspartic acid | Asp | D | polar | acidic | −3.5 |
| Cysteine | Cys | C | polar | neutral | 2.5 |
| Glutamic acid | Glu | E | polar | acidic | −3.5 |
| Glutamine | Gln | Q | polar | neutral | −3.5 |
| Histidine | His | H | polar | basic | −3.2 |
| Lysine | Lys | K | polar | basic | −3.9 |
| Serine | Ser | S | polar | neutral | −0.8 |
| Threonine | Thr | T | polar | neutral | −0.7 |
| Tyrosine | Tyr | Y | polar | neutral | −1.3 |
| Alanine | Ala | A | nonpolar | neutral | 1.8 |
| Glycine | Gly | G | nonpolar | neutral | −0.4 |
| Isoleucine | Ile | I | nonpolar | neutral | 4.5 |
| Leucine | Leu | L | nonpolar | neutral | 3.8 |
| Methionine | Met | M | nonpolar | neutral | 1.9 |
| Phenylalanine | Phe | F | nonpolar | neutral | 2.8 |
| Proline | Pro | P | nonpolar | neutral | −1.6 |
| Tryptophan | Trp | W | nonpolar | neutral | −0.9 |
| Valine | Val | V | nonpolar | neutral | 4.2 |

A transmembrane domain in a protein may be identified using a number of techniques well known in the art such as X-ray crystallography, NMR, gene fusion techniques, substituted cysteine accessibility methods, Asp(N)-linked glycosylation experiments. Additionally or alternatively computer algorithms may be used to predict transmembrane domains. Examples of such domains have been described and are available at institutions providing bioinformatic services (Möller et al. 2001. Bioinformatics 17, 646). Use of one such algorithm to predict the transmembrane domains in a YTP polypeptide is shown in the Examples section herein.

DUF221 domain refers to a conserved amino acid sequence found in some proteins of eukaryotic origin. DUF221 domains are usually 350 to 550 residues in length. Examples of DUF221 domains comprised in YTP polypeptides originating from *Arabidopsis thaliana* and *Oryza sativa* are represented by SEQ ID NO: 518 to SEQ ID NO: 543. A consensus sequence representing the sequence SEQ ID NO: 518 to SEQ ID NO: 543 is given in SEQ ID NO: 544.

A preferred YTP polypeptide of the invention comprises a least 50 contiguous amino acids of a DUF221 domain having in increasing order of preference at least 50%, 55%, 60%, 65%, 70%, 75%, 80%, 85%, 90%, 95%, 96%, 97%, 98%, 99%, or 100% sequence identity with any one of the domains represented by SEQ ID NO: 518 to SEQ ID NO: 544. The sequence similarity is preferably established in a local alignment using algorithms well known in the art such as Blast.

A YTP polypeptide may readily be identified by searching in specialized databases containing conserved protein domains such as Pfam, (Finn et al. Nucleic Acids Research (2006) Database Issue 34:D247-D251). Tools useful in searching such databases are well known in the art, for example INTERPRO (European Bioinformatics institute, UK) which allows searching several protein domain databases simultaneously.

A DUF221 domain may be identified by sequence comparison with known polypeptides comprising a DUF221 domain and establishing the percentage similarity over the region of the DUF221 domain. The sequences may be aligned using any of the methods well known in the art such as Blast (for local alignment) or BestFit (for global alignment) algorithms. The probability of the alignment with a given sequence is taken as basis for identifying similar polypeptides. A parameter that is typically used to represent such probability is called e-value. The e-value is a measure of the reliability of the score "S". "S" is a measure of the similarity between the two sequences aligned. The e-value describes how often a given "S" score is expected to occur at random. The e-value cut-off may be as high as 1.0. The typical threshold for a trusted (true) hit showing significant sequence homology to the query sequence and resulting from a BLAST search is lower than $1.e^{-5}$, in some instance an even lower threshold is taken, for example $1.e^{-10}$, or even lower.

Preferably YTP polypeptides useful in the methods of the invention comprise at least 50 contiguous amino acids of a DUF221 domain having in increasing order of preference an e-value lower than $1.e^{-5}$, $1.e^{-10}$, $1.e^{-15}$, $1.e^{-20}$, $1.e^{-25}$, $1.e^{-50}$, $1.e^{-75}$, $1.e^{-100}$, $1.e^{-200}$, $1.e^{-300}$, $1.e^{-400}$, $1.e^{-500}$, $1.e^{-600}$, $1.e^{-700}$ and $1.e^{-800}$ in an local alignment with a DUF221 domain found in a known YTP polypeptide, such as any of the polypeptides of Table A.

It should be understood that the nucleic acids encoding a YTP polypeptide according to the invention it is not restricted to sequences of natural origin. The nucleic acid may encode a "de novo" designed YTP polypeptide.

Alternatively or additionally the YTP protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 409.

The overall sequence identity is determined using a global alignment algorithm, such as the Needleman Wunsch algorithm in the program GAP (GCG Wisconsin Package, Accelrys), preferably with default parameters. Compared to overall sequence identity, the sequence identity will generally be higher when only conserved domains or motifs are considered.

Preferably, a YTP polypeptide sequence when used in the construction of a phylogenetic tree, such as the one depicted in FIG. 21, clusters with the Group 1, comprising the amino acid sequence represented by SEQ ID NO: 409 rather than with the YTP polypeptides in Group 2.

The term "domain" and "motif" is defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32: D134-D137, (2004)), or Pfam (Bateman et al., Nucleic Acids Research 30(1): 276-280 (2002). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)).

Analysis of the polypeptide sequence of SEQ ID NO: 2 is presented below in Examples 2 and 4 herein. For example, a GRF polypeptide as represented by SEQ ID NO: 2 comprises a QLQ domain with an InterPro accession IPR014978 (PFAM accession PF08880) and a WRC domain with an InterPro accession IPR014977 (PFAM accession PF08879) in the InterPro domain database. Domains may also be identified using routine techniques, such as by sequence alignment. An alignment of the QLQ domain of the polypeptides of Table A herein, is shown in FIG. 2, and alignment of the WRC domain of the polypeptides of Table A herein, is shown in FIG. 3. Such alignments are useful for identifying the most conserved amino acids between the GRF polypeptides, such as the QLQ and WRC amino acid residues.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., (2003) BMC Bioinformatics, 10: 29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid sequence or polypeptide sequence or over selected domains or conserved motif(s), using the programs mentioned above using the default parameters.

For local alignments, the Smith-Waterman algorithm is particularly useful (Smith T F, Waterman M S (1981) J. Mol. Biol 147(1); 195-7).

Outside of the QLQ domain and of the WRC domain, GRF polypeptides reputedly have low amino acid sequence identity. Example 3 herein describes in Table B the percentage identity between the GRF polypeptide as represented by SEQ ID NO: 2 and the GRF polypeptides listed in Table A, which can be as low as 15% amino acid sequence identity. The percentage identity can be substantially increased if the identity calculation is performed between the QLQ domain SEQ ID NO: 2 (as represented by SEQ ID NO: 115 comprised in SEQ ID NO: 2; QLQ domain of the GRF polypeptides of Table A represented in FIG. 2) and the QLQ domains of the polypeptides useful in performing the invention. Similarly, the percentage identity can be substantially increased if the identity calculation is performed between the WRC domain SEQ ID NO: 2 (as represented by SEQ ID NO: 116 comprised in SEQ ID NO: 2; WRC domain of the GRF polypeptides of Table A represented in FIG. 3) and the WRC domains of the polypeptides useful in performing the invention. Percentage identity over the QLQ domain amongst the polypeptide sequences useful in performing the methods of the invention ranges between 25% and 99% amino acid identity, and percentage identity over the WRC domain amongst the polypeptide sequences useful in performing the methods of the invention ranges between 60% and 99% amino acid identity. As can also be observed in FIG. 3, the WRC domain is better conserved amongst the different GRF polypeptides than the QLQ domain, as shown in FIG. 2.

The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP and others.

Furthermore, GRF polypeptides useful in the methods of the present invention (at least in their native form) typically, but not necessarily, have transcriptional regulatory activity and capacity to interact with other proteins. Therefore, GRF polypeptides with reduced transcriptional regulatory activity, without transcriptional regulatory activity, with reduced protein-protein interaction capacity, or with no protein-protein interaction capacity, may equally be useful in the methods of the present invention. DNA-binding activity and protein-protein interactions may readily be determined in vitro or in vivo using techniques well known in the art (for example in Current Protocols in Molecular Biology, Volumes 1 and 2, Ausubel et al. (1994), Current Protocols). GRF polypeptides are capable of transcriptional activation of reporter genes in yeast cells (Kim & Kende (2004) Proc Natl Acad Sci 101(36): 13374-13379). GRF polypeptides are also capable of interacting with GRF-interacting factor polypeptides (GIF1 to GIF3; also called synovial sarcoma translocation (SYT) polypeptides, SYT1 to SYT3) in vivo in yeast cells, using a yeast two-hybrid protein-protein interaction assay (Kim & Kende, supra). In vitro binding assays are also used to show that GRF polypeptides and GIF (also called SYT) polypeptides are interacting partners (Kim & Kende, supra).

The present invention is illustrated in one embodiment by transforming plants with the nucleic acid sequence represented by SEQ ID NO: 1, encoding the GRF polypeptide sequence of SEQ ID NO: 2. However, performance of the invention is not restricted to these sequences; the methods of the invention may advantageously be performed using any nucleic acid sequence encoding a GRF polypeptide as defined herein.

The present invention is illustrated in one embodiment by transforming plants with the nucleic acid sequence represented by SEQ ID NO: 120, encoding the polypeptide sequence of SEQ ID NO: 121. However, performance of the invention is not restricted to these sequences; the methods of the invention may advantageously be performed using any RAA1-like-encoding nucleic acid or RAA1-like polypeptide as defined herein.

In addition, RAA1-like polypeptides, when expressed in rice according to the methods of the present invention as outlined in the examples, give plants having increased yield related traits, in particular increased root/shoot index, increased number of flowers per panicle and increased Thousand Kernel Weight.

Transmembrane domains are about 15 to 30 amino acids long and are usually composed of hydrophobic residues that form an alpha helix. They are usually predicted on the basis of hydrophobicity (for example Klein et al., Biochim. Biophys. Acta 815, 468, 1985; or Sonnhammer et al., In J. Glasgow, T. Littlejohn, F. Major, R. Lathrop, D. Sankoff, and C. Sensen, editors, Proceedings of the Sixth International Conference on Intelligent Systems for Molecular Biology, pages 175-182, Menlo Park, Calif., 1998. AAAI Press.).

Examples of proteins falling under the definition of "SYR polypeptide or a homologue thereof" are given in Table A of the examples section and include sequences from various monocotyledonous plants, such as rice (SEQ ID NO: 169, SEQ ID NO: 179 and SEQ ID NO: 180), corn (SEQ ID NO: 181), wheat (SEQ ID NO: 182), barley (SEQ ID NO: 183), sugarcane (SEQ ID NO: 184 and SEQ ID NO: 185), *sorghum* (SEQ ID NO: 186); and from dicotyledonous plants such as *Arabidopsis* (SEQ ID NO: 187 and SEQ ID NO: 188), grape (SEQ ID NO: 189), citrus (SEQ ID NO: 190) or tomato (SEQ ID NO: 191 and SEQ ID NO: 192). It is envisaged that the Leu rich domain is important for the function of the protein, hence proteins with the Leu rich domain but without the conserved motifs 5 or 6 may be useful as well in the methods of the present invention; examples of such proteins are given in SEQ ID NO: 201 and 202.

It is to be understood that the term "SYR polypeptide or a homologue thereof" is not to be limited to the sequence represented by SEQ ID NO: 169 or to the homologues listed as SEQ ID NO: 179 to SEQ ID NO: 192, but that any polypeptide of about 65 to about 200 amino acids meeting the criteria of comprising a leucine rich domain as defined above, preceded by the conserved tripeptide motif 5 (a, b, c or d) and followed by the conserved motif 6 and preferably also by the conserved motif 7; or having at least 38% sequence identity to the sequence of SEQ ID NO: 169, may be suitable for use in the methods of the invention.

The activity of a SYR protein or homologue thereof may be assayed by expressing the SYR protein or homologue thereof under control of a GOS2 promoter in *Oryza sativa*, which results in plants with increased increased biomass and/or seed yield without a delay in flowering time when grown under conditions of nitrogen deficiency or under drought stress conditions, and compared to corresponding wild type plants. This increase in seed yield may be measured in several ways, for example as an increase of total seed weight, number of filled seeds, fillrate, harvest index or Thousand Kernel Weight.

The present invention is illustrated in one embodiment by transforming plants with the nucleic acid sequence represented by SEQ ID NO: 168, encoding the polypeptide sequence of SEQ ID NO: 169. However, performance of the invention is not restricted to these sequences; the methods of the invention may advantageously be performed using any SYR-encoding nucleic acid or SYR polypeptide as defined herein.

Furthermore, ARKL polypeptides (at least in their native form) typically have E3 ubiquitin-protein ligase activity. Tools and techniques for measuring E3 ubiquitin-protein ligase activity are well known in the art (U.S. Pat. No. 6,737,244; WO/2001/075145; Miura et al. (2005) Proc Natl Acad Sci USA. 102(21): 7760-7765; Kawasaki et al. (2005) The Plant Journal 44, 258-270. Briefly E3 ubiquitin ligase activity of an ARKL polypeptide can be assayed by incubating the ARKL protein with an E1 and E2 proteins and tagged ubiquitin. The ubiquitinated proteins can be detected after SDS-PAGE electrophresis and blotting using an antibody to the tag of the ubiquitin. Examples of E1 and E2 proteins that may be useful in the assay are the Wheat E1 and the *Arabidopsis thaliana* AtUBC1 E2 protein. Tagged ubiquitin with histidine and antibodies to detect it are commercially available (Calbiochem, San Diego, Calif., USA).

In addition, ARKL polypeptides, when expressed in rice according to the methods of the present invention as outlined in the examples, give plants having increased yield related traits, in particular thousand kernel weight, total seed yield, early vigour and/or harvest index.

The present invention is illustrated in one embodiment by transforming plants with the nucleic acid sequence represented by SEQ ID NO: 212, encoding the polypeptide sequence of SEQ ID NO: 213. However, performance of the invention is not restricted to these sequences; the methods of the invention may advantageously be performed using any ARKL-encoding nucleic acid or ARKL polypeptide as defined herein.

Furthermore, YTP polypeptides typically have seed yield enhancing activity. Tools and techniques for measuring yield enhancing (or improving) activity are well known in the art. Further details are provided in the Examples section herein.

In addition, YTP polypeptides, when expressed and phenotypically evaluated in rice according to the methods of the present invention as outlined in Examples 10 to 15, give plants having increased yield related traits, in particular one or more of total seed weight, thousand kernel weight, number of flowers per panicle, seed filling rate and harvest index.

The present invention is illustrated in one embodiment by transforming plants with the nucleic acid sequence represented by SEQ ID NO: 408, encoding the polypeptide sequence of SEQ ID NO: 409. However, performance of the invention is not restricted to these sequences; the methods of the invention may advantageously be performed using any YTP-encoding nucleic acid or YTP polypeptide as defined herein.

Examples of nucleic acid sequences encoding polypeptides of the invention are given in Table A of Example 1 herein, specially nucleic acid sequences encoding polypeptides selected from the group consisting of:
GRF polypeptide are given in Table A1,
RAA1-like polypeptide are given in Table A2,
SYR polypeptide are given in Table A3,
ARKL polypeptide are given in Table A4, and
YTP polypeptide are given in Table A5 respectively.

Such nucleic acid sequences are useful in performing the methods of the invention. The polypeptide sequences given in Table A of Example 1 are example sequences of orthologues and paralogues of the polypeptide selected from the group consisting of: GRF polypeptide, RAA1-like polypeptide, SYR polypeptide, ARKL polypeptide, and YTP represented by SEQ ID NO: 2, 121, 169, 213 or 409 respectively the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1, 120, 168, 212 or 408 respectively or SEQ ID NO: 2, 121, 169, 213 or 409 respectively the second BLAST would therefore be against *Arabidopsis thaliana* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

The term "table A" used in this specification is to be taken to specify the content of table A1, A2, A3, A4 and/or A5. The term "table A1" used in this specification is to be taken to specify the content of table A1. The term "table A2" used in this specification is to be taken to specify the content of table A2. The term "table A3" used in this specification is to be taken to specify the content of table A3. The term "table A4" used in this specification is to be taken to specify the content of table A4. The term "table A5" used in this specification is to be taken to specify the content of table A5.

In one preferred embodiment, the term "table A" means table A1. In one preferred embodiment, the term "table A" means table A2. In one preferred embodiment, the term "table A" means table A3. In one preferred embodiment, the term "table A" means table A4. In one preferred embodiment, the term "table A" means table A5.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acid sequences encoding homologues and derivatives of any one of the polypeptide sequences given in Table A of Example 1, the terms "homologue" and "derivative" being as defined herein. Also useful in the methods of the invention are nucleic acid sequences encoding homologues and derivatives of orthologues or paralogues of any one of the polypeptide sequences given in Table A of Example 1. Homologues and derivatives useful in the methods of the present invention have substantially the same biological and functional activity as the unmodified protein from which they are derived.

In one embodiment of the invention, a preferred derivative useful in the methods of the invention is an ARKL polypeptide a cystein residue at the position of ligand 5 (see FIG. 15) in the in the RING finger domain coordinating one of the Zinc ions. Another preferred derivative useful in the methods of the invention is an ARKL polypeptide having seven cysteins and one histidine (ZfC3HC4) as residues at the zinc ion ligand positions.

Further nucleic acid variants useful in practising the methods of the invention include portions of nucleic acid sequences encoding polypeptides selected from the group consisting of: GRF polypeptides, RAA1-like polypeptides, SYR polypeptides, ARKL polypeptides, and YTP polypeptides respectively, nucleic acid sequences hybridising to nucleic acid sequences encoding polypeptides selected from the group consisting of: GRF polypeptides, RAA1-like polypeptides, SYR polypeptides, ARKL polypeptides, and YTP polypeptides respectively, splice variants of nucleic acid sequences encoding polypeptides selected from the group consisting of: GRF polypeptides, RAA1-like polypeptides, SYR polypeptides, ARKL polypeptides, and YTP polypeptides respectively, allelic variants of nucleic acid sequences encoding polypeptides selected from the group consisting of: GRF polypeptides, RAA1-like polypeptides, SYR polypeptides, ARKL polypeptides, and YTP polypeptides respectively and variants of nucleic acid sequences encoding polypeptides selected from the group consisting of: GRF polypeptides, RAA1-like polypeptides, SYR polypeptides, ARKL polypeptides, and YTP polypeptides respectively obtained by gene shuffling. The terms hybridising sequence, splice variant, allelic variant and gene shuffling are as described herein.

Nucleic acid sequences encoding polypeptides selected from the group consisting of: GRF polypeptides, RAA1-like polypeptides, SYR polypeptides, ARKL polypeptides, and YTP polypeptides respectively need not be full-length nucleic acid sequences, since performance of the methods of the invention does not rely on the use of full-length nucleic acid sequences. According to the present invention, there is provided a method for increasing yield-related traits, in plants, comprising introducing and expressing in a plant a portion of any one of the nucleic acid sequences given in Table A of Example 1, or a portion of a nucleic acid sequence encoding an orthologue, paralogue or homologue of any of the polypeptide sequences given in Table A of Example 1.

A portion of a nucleic acid sequence may be prepared, for example, by making one or more deletions to the nucleic acid sequence. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Portions useful in the methods of the invention, encode in one embodiment a GRF polypeptide as defined herein, and have substantially the same biological activity as the polypeptide sequences given in Table A1 of Example 1. Preferably, the portion is a portion of any one of the nucleic acid sequences given in Table A1 of Example 1, or is a portion of a nucleic acid sequence encoding an orthologue or paralogue of any one of the polypeptide sequences given in Table A1 of Example 1. Preferably the portion is, in increasing order of preference at least 400, 450, 500, 550, 600, 650, 700, 750, 800, 850, 900, 950, 1000, 1050, 1100, 1150, 1190 consecutive nucleotides in length, the consecutive nucleotides being of any one of the nucleic acid sequences given in Table A1 of Example 1, or of a nucleic acid sequence encoding an orthologue or paralogue of any one of the polypeptide sequences given in Table A1 of Example 1. Preferably, the portion is a portion of a nucleic sequence encoding a polypeptide sequence polypeptide comprising: (i) a domain having at least 50%, 55%, 60%, 65%, 70%, 75%, 80%, 85%, 90%, 95%, 98%, 99% or more amino acid sequence identity to a QLQ domain as represented by SEQ ID NO: 115; and (ii) a domain having at least 50%, 55%, 60%, 65%, 70%, 75%, 80%, 85%, 90%, 95%, 98%, 99% or more amino acid sequence identity to a WRC domain as represented by SEQ ID NO: 116. Most preferably the portion is a portion of the nucleic acid sequence of SEQ ID NO: 1.

Portions useful in the methods of the invention, encode in one embodiment a RAA1-like polypeptide as defined herein, and have substantially the same biological activity as the amino acid sequences given in Table A2 of Example 1. Preferably, the portion is a portion of any one of the nucleic acids given in Table A2 of Example 1, or is a portion of a nucleic acid encoding an orthologue or paralogue of any one of the amino acid sequences given in Table A2 of Example 1. Preferably the portion is at least 250, 300, 350, 400, 450, 500, 550, 600, 650, 700, 750, 800, 850, 900, 950, 1000, 1100, 1200, 1300, 1400, 1500, 1600, 1700, 1800, 1900, 2000, 2100, 2200 consecutive nucleotides in length, the consecutive nucleotides being of any one of the nucleic acid sequences given in Table A2 of Example 1, or of a nucleic acid encoding an orthologue or paralogue of any one of the amino acid sequences given in Table A2 of Example 1. Most preferably the portion is a portion of the nucleic acid of SEQ ID NO: 120. Preferably, the portion encodes a fragment of an amino acid sequence which, when used in the construction of a phylogenetic tree, such as the one depicted in FIG. 8, clusters with the group of RAA1-like polypeptides comprising the amino acid sequence represented by SEQ ID NO: 121 rather than with any other group.

Portions useful in the methods of the invention, encode in one embodiment a SYR polypeptide as defined herein, and have substantially the same biological activity as the amino acid sequences given in Table A3 of Example 1. Preferably, the portion is a portion of any one of the nucleic acids given in Table A3 of Example 1, or is a portion of a nucleic acid encoding an orthologue or paralogue of any one of the amino acid sequences given in Table A3 of Example 1. Preferably the portion is at least 150, 200, 250, 300, 350, 400, 450, 500, 550, 600 consecutive nucleotides in length, the consecutive nucleotides being of any one of the nucleic acid sequences given in Table A3 of Example 1, or of a nucleic acid encoding an orthologue or paralogue of any one of the amino acid sequences given in Table A3 of Example 1. Most preferably the portion is a portion of the nucleic acid of SEQ ID NO: 168. Preferably, the portion encodes encodes a polypeptide of about 65 to about 200 amino acids, comprising a leucine rich domain as defined above, preceded by the conserved tripeptide motif 5 (a, b, c or d) and followed by the conserved motif 6 and preferably also by the conserved motif 7; or having at least 38% sequence identity to the sequence of SEQ ID NO: 169.

Portions useful in the methods of the invention, encode in one embodiment an ARKL polypeptide as defined herein, and have substantially the same biological activity as the amino acid sequences given in Table A4 of Example 1. Preferably, the portion is a portion of any one of the nucleic acids given in Table A4 of Example 1, or is a portion of a nucleic acid encoding an orthologue or paralogue of any one of the amino acid sequences given in Table A4 of Example 1. Preferably the portion is at least 500, 550, 600, 650, 700, 750, 800, 850, 900, 950, 1000, consecutive nucleotides in length, the consecutive nucleotides being of any one of the nucleic acid sequences given in Table A4 of Example 1, or of a nucleic acid encoding an orthologue or paralogue of any one of the amino acid sequences given in Table A4 of Example 1. Most preferably the portion is a portion of the nucleic acid of SEQ ID NO: 212. Preferably, the portion encodes a fragment of an amino acid sequence which, when used in the construction of a phylogenetic tree, such as the one depicted in FIG. 17, clusters with the group of ARKL polypeptides comprising the amino acid sequence represented by SEQ ID NO: 213 rather than with any other group such as that represented by the Musmu_Goliath sequence.

Portions useful in the methods of the invention, encode in one embodiment a YTP polypeptide as defined herein, and have substantially the same biological activity as the amino acid sequences given in Table A5 of Example 1. Preferably, the portion is a portion of any one of the nucleic acids given in Table A5 of Example 1, or is a portion of a nucleic acid encoding an orthologue or paralogue of any one of the amino acid sequences given in Table A5 of Example 1. Preferably the portion is at least 300, 400, 500, 550, 600, 650, 700, 750, 800, 850, 900, 950, 1000, 1500, 2000, 2500, 3000 consecutive nucleotides in length, the consecutive nucleotides being of any one of the nucleic acid sequences given in Table A5 of Example 1, or of a nucleic acid encoding an orthologue or paralogue of any one of the amino acid sequences given in Table A5 of Example 1. Most preferably the portion is a portion of the nucleic acid of SEQ ID NO: 408. Preferably, the portion encodes a fragment of an amino acid sequence which, when used in the construction of a phylogenetic tree, such as the one depicted in FIG. 21, clusters with the Group 1, comprising the amino acid sequence represented by SEQ ID NO: 409 rather than with the YTP polypeptides in Group 2.

Another nucleic acid sequence variant useful in the methods of the invention is a nucleic acid sequence capable of hybridising, under reduced stringency conditions, preferably under stringent conditions, with a nucleic acid sequence encoding a polypeptide selected from the group consisting of: GRF polypeptide, RAA1-like polypeptide, SYR polypeptide, ARKL polypeptide, and YTP polypeptide respectively as defined herein, or with a portion as defined herein.

According to the present invention, there is provided a method for increasing yield-related traits in plants, comprising introducing and expressing in a plant a nucleic acid sequence capable of hybridizing to any one of the nucleic acid sequences given in Table A of Example 1, or comprising introducing and expressing in a plant a nucleic acid sequence capable of hybridising to a nucleic acid sequence encoding an orthologue, paralogue or homologue of any of the nucleic acid sequences given in Table A of Example 1.

Hybridising sequences useful in the methods of the invention encode a polypeptide selected from the group consisting of: GRF polypeptide, RAA1-like polypeptide, SYR polypeptide, ARKL polypeptide, and YTP polypeptide respectively as defined herein, and have substantially the same biological activity as the polypeptide sequences given in Table A of Example 1. Preferably, the hybridising sequence is capable of hybridising to any one of the nucleic acid sequences given in Table A of Example 1, or to a portion of any of these sequences, a portion being as defined above, or wherein the hybridising sequence is capable of hybridising to a nucleic acid sequence encoding an orthologue or paralogue of any one of the polypeptide sequences given in Table A of Example 1. Preferably, in one embodiment the hybridising sequence is capable of hybridising to a nucleic acid sequence encoding a polypeptide sequence comprising: (i) a domain having at least 50%, 55%, 60%, 65%, 70%, 75%, 80%, 85%, 90%, 95%, 98%, 99% or more amino acid sequence identity to a QLQ domain as represented by SEQ ID NO: 115; and (ii) a domain having at least 50%, 55%, 60%, 65%, 70%, 75%, 80%, 85%, 90%, 95%, 98%, 99% or more amino acid sequence identity to a WRC domain as represented by SEQ ID NO: 116. Most preferably, the hybridising sequence is capable of hybridising to a nucleic acid sequence as represented by SEQ ID NO: 1 or to a portion thereof.

Preferably, in one embodiment the hybridising sequence is capable of hybridising to a nucleic acid as represented by SEQ ID NO: 120 or to a portion thereof.

Preferably, the hybridising sequence encodes a polypeptide with an amino acid sequence which, when full-length and used in the construction of a phylogenetic tree, such as the one depicted in FIG. 8, clusters with the group of RAA1-like polypeptides comprising the amino acid sequence represented by SEQ ID NO: 121 rather than with any other group.

Preferably, in one embodiment the hybridising sequence is capable of hybridising to a nucleic acid as represented by SEQ ID NO: 168 or to a portion thereof.

Preferably, the hybridising sequence encodes a polypeptide of about 65 to about 200 amino acids, comprising a leucine rich domain as defined above, preceded by the conserved tripeptide motif 5 (a, b, c or d) and followed by the conserved motif 6 and preferably also by the conserved motif 7; or having at least 38% sequence identity to the sequence of SEQ ID NO: 169.

Preferably, in one embodiment the hybridising sequence is capable of hybridising to a nucleic acid as represented by SEQ ID NO: 212 or to a portion thereof.

Preferably, the hybridising sequence encodes a polypeptide with an amino acid sequence which, when full-length and used in the construction of a phylogenetic tree, such as the one depicted in FIG. 17, clusters with the group of ARKL polypeptides comprising the amino acid sequence represented by SEQ ID NO: 213 rather than with any other group such as that represented by the Musmu_Goliath sequence.

Preferably, in one embodiment the hybridising sequence is capable of hybridising to a nucleic acid as represented by SEQ ID NO: 408 or to a portion thereof.

Preferably, the hybridising sequence encodes a polypeptide with an amino acid sequence which, when full-length and used in the construction of a phylogenetic tree, such as the one with in FIG. 21, clusters with the Group 1, comprising the amino acid sequence represented by SEQ ID NO: 409 rather than with the YTP polypeptides in Group 2.

Another nucleic acid sequence variant useful in the methods of the invention is a splice variant encoding a polypeptide selected from the group consisting of: GRF polypeptide, RAA1-like polypeptide, SYR polypeptide, ARKL polypeptide, and YTP polypeptide respectively as defined hereinabove, a splice variant being as defined herein.

According to the present invention, there is provided a method for increasing yield-related traits, comprising introducing and expressing in a plant a splice variant of any one of the nucleic acid sequences given in Table A of Example 1, or a splice variant of a nucleic acid sequence encoding an orthologue, paralogue or homologue of any of the polypeptide sequences given in Table A of Example 1.

Preferred splice variants are in one embodiment splice variants of a nucleic acid sequence represented by SEQ ID NO: 1, or a splice variant of a nucleic acid sequence encoding an orthologue or paralogue of SEQ ID NO: 2. Preferably, the splice variant is a splice variant of a nucleic acid sequence encoding a polypeptide sequence comprising: (i) a domain having at least 50%, 55%, 60%, 65%, 70%, 75%, 80%, 85%, 90%, 95%, 98%, 99% or more amino acid sequence identity to a QLQ domain as represented by SEQ ID NO: 115; and (ii) a domain having at least 50%, 55%, 60%, 65%, 70%, 75%, 80%, 85%, 90%, 95%, 98%, 99% or more amino acid sequence identity to a WRC domain as represented by SEQ ID NO: 116.

Preferred splice variants are in one embodiment splice variants of a nucleic acid represented by SEQ ID NO: 120, or a splice variant of a nucleic acid encoding an orthologue or paralogue of SEQ ID NO: 121. Preferably, the amino acid sequence encoded by the splice variant, when used in the construction of a phylogenetic tree, such as the one depicted in FIG. 8, clusters with the group of RAA1-like polypeptides comprising the amino acid sequence represented by SEQ ID NO: 121 rather than with any other group.

Preferred splice variants are in one embodiment splice variants of a nucleic acid represented by SEQ ID NO: 168, or a splice variant of a nucleic acid encoding an orthologue or paralogue of SEQ ID NO: 169. Preferably, the amino acid sequence encoded by the splice variant is a polypeptide of about 65 to about 200 amino acids, comprising a leucine rich domain as defined above, preceded by the conserved tripeptide motif 5 (a, b, c or d) and followed by the conserved motif 6 and preferably also by the conserved motif 7; or having at least 38% sequence identity to the sequence of SEQ ID NO: 169.

Preferred splice variants are in one embodiment splice variants of a nucleic acid represented by SEQ ID NO: 212, or a splice variant of a nucleic acid encoding an orthologue or paralogue of SEQ ID NO: 213. Preferably, the amino acid sequence encoded by the splice variant, when used in the construction of a phylogenetic tree, such as the one depicted in FIG. 17, clusters with the group of ARKL polypeptides comprising the amino acid sequence represented by SEQ ID NO: 213 rather than with any other group such as that represented by the Musmu_Goliath sequence.

Preferred splice variants are in one embodiment splice variants of a nucleic acid represented by SEQ ID NO: 408, or a splice variant of a nucleic acid encoding an orthologue or paralogue of SEQ ID NO: 409. Preferably, the amino acid sequence encoded by the splice variant, when used in the construction of a phylogenetic tree, such as the one depicted in FIG. 21, clusters with the Group 1, comprising the amino acid sequence represented by SEQ ID NO: 409 rather than with the YTP polypeptides in Group 2.

Another nucleic acid sequence variant useful in performing the methods of the invention is an allelic variant of a nucleic acid sequence encoding a polypeptide selected from the group consisting of: GRF polypeptide, RAA1-like polypeptide, SYR polypeptide, ARKL polypeptide, and YTP polypeptide respectively as defined hereinabove, an allelic variant being as defined herein.

According to the present invention, there is provided a method for increasing yield-related traits, comprising introducing and expressing in a plant an allelic variant of any one of the nucleic acid sequences given in Table A of Example 1, or comprising introducing and expressing in a plant an allelic variant of a nucleic acid sequence encoding an orthologue, paralogue or homologue of any of the polypeptide sequences given in Table A of Example 1.

The allelic variants useful in one embodiment of the present invention have substantially the same biological activity as the GRF polypeptide of SEQ ID NO: 2 and any of the polypeptide sequences depicted in Table A of Example 1. Allelic variants exist in nature, and encompassed within the methods of the present invention is the use of these natural alleles. Preferably, the allelic variant is an allelic variant of SEQ ID NO: 1 or an allelic variant of a nucleic acid sequence encoding an orthologue or paralogue of SEQ ID NO: 2. Preferably, the allelic variant is an allelic variant of a polypeptide sequence comprising: (i) a domain having at least 50%, 55%, 60%, 65%, 70%, 75%, 80%, 85%, 90%, 95%, 98%, 99% or more amino acid sequence identity to a QLQ domain as represented by SEQ ID NO: 115; and (ii) a domain having at least 50%, 55%, 60%, 65%, 70%, 75%, 80%, 85%, 90%, 95%, 98%, 99% or more amino acid sequence identity to a WRC domain as represented by SEQ ID NO: 116.

The allelic variants useful in one embodiment of the present invention have substantially the same biological activity as the RAA1-like polypeptide of SEQ ID NO: 121 and any of the amino acids depicted in Table A of Example 1. Allelic variants exist in nature, and encompassed within the methods of the present invention is the use of these natural alleles. Preferably, the allelic variant is an allelic variant of SEQ ID NO: 120 or an allelic variant of a nucleic acid encoding an orthologue or paralogue of SEQ ID NO: 121. Preferably, the amino acid sequence encoded by the allelic variant, when used in the construction of a phylogenetic tree, such as the one depicted in FIG. 8, clusters with the RAA1-like polypeptides comprising the amino acid sequence represented by SEQ ID NO: 121 rather than with any other group.

The allelic variants useful in one embodiment of the present invention have substantially the same biological activity as the SYR polypeptide of SEQ ID NO: 169 and any of the amino acids depicted in Table A of Example 1. Allelic variants exist in nature, and encompassed within the methods of the present invention is the use of these natural alleles. Preferably, the allelic variant is an allelic variant of SEQ ID NO: 168 or an allelic variant of a nucleic acid encoding an orthologue or paralogue of SEQ ID NO: 169. Preferably, the amino acid sequence encoded by the allelic variant is a polypeptide of about 65 to about 200 amino acids, comprising a leucine rich domain as defined above, preceded by the conserved tripeptide motif 5 (a, b, c or d) and followed by the conserved motif 6 and preferably also by the conserved motif 7; or having at least 38% sequence identity to the sequence of SEQ ID NO: 169.

The allelic variants useful in one embodiment of the present invention have substantially the same biological activity as the ARKL polypeptide of SEQ ID NO: 213 and any of the amino acids depicted in Table A of Example 1. Allelic variants exist in nature, and encompassed within the methods of the present invention is the use of these natural alleles. Preferably, the allelic variant is an allelic variant of SEQ ID NO: 212 or an allelic variant of a nucleic acid encoding an orthologue or paralogue of SEQ ID NO: 213. Preferably, the amino acid sequence encoded by the allelic variant, when used in the construction of a phylogenetic tree, such as the one depicted in FIG. 17, clusters with the group of ARKL polypeptides comprising the amino acid sequence represented by SEQ ID NO: 213 rather than with any other group such as that represented by the Musmu_Goliath sequence.

The allelic variants useful in one embodiment of the present invention have substantially the same biological activity as the YTP polypeptide of SEQ ID NO: 409 and any of the amino acids depicted in Table A of Example 1. Allelic variants exist in nature, and encompassed within the methods of the present invention is the use of these natural alleles. Preferably, the allelic variant is an allelic variant of SEQ ID NO: 408 or an allelic variant of a nucleic acid encoding an orthologue or paralogue of SEQ ID NO: 409. Preferably, the amino acid sequence encoded by the allelic variant, when used in the construction of a phylogenetic tree, such as the one depicted in FIG. 21, clusters with the Group 1, comprising the amino acid sequence represented by SEQ ID NO: 409 rather than with the YTP polypeptides in Group 2.

Gene shuffling or directed evolution may also be used to generate variants of nucleic acid sequences encoding a polypeptide selected from the group consisting of: GRF polypeptide, RAA1-like polypeptide, SYR polypeptide, ARKL polypeptide, and YTP polypeptides respectively as defined above, the term "gene shuffling" being as defined herein.

According to the present invention, there is provided a method for increasing yield-related traits, comprising introducing and expressing in a plant a variant of any one of the nucleic acid sequences given in Table A of Example 1, or comprising introducing and expressing in a plant a variant of a nucleic acid sequence encoding an orthologue, paralogue or homologue of any of the polypeptide sequences given in Table A of Example 1, which variant nucleic acid sequence is obtained by gene shuffling.

Preferably in one embodiment, the variant nucleic acid sequence obtained by gene shuffling encodes a polypeptide sequence comprising: (i) a domain having at least 50%, 55%, 60%, 65%, 70%, 75%, 80%, 85%, 90%, 95%, 98%, 99% or more amino acid sequence identity to a QLQ domain as represented by SEQ ID NO: 115; and (ii) a domain having at least 50%, 55%, 60%, 65%, 70%, 75%, 80%, 85%, 90%, 95%, 98%, 99% or more amino acid sequence identity to a WRC domain as represented by SEQ ID NO: 116.

Preferably in one embodiment, the amino acid sequence encoded by the variant nucleic acid obtained by gene shuffling, when used in the construction of a phylogenetic tree such as the one depicted in FIG. 8, clusters with the group of RAA1-like polypeptides comprising the amino acid sequence represented by SEQ ID NO: 121 rather than with any other group. Preferably in one embodiment, the amino acid sequence encoded by the variant nucleic acid obtained by gene shuffling is a polypeptide of about 65 to about 200 amino acids, comprising a leucine rich domain as defined above, preceded by the conserved tripeptide motif 5 (a, b, c or d) and followed by the conserved motif 6 and preferably also by the conserved motif 7; or having at least 38% sequence identity to the sequence of SEQ ID NO: 169.

Preferably in one embodiment, the amino acid sequence encoded by the variant nucleic acid obtained by gene shuffling, when used in the construction of a phylogenetic tree such as the one depicted in FIG. 17, clusters with the group of ARKL polypeptides comprising the amino acid sequence represented by SEQ ID NO: 213 rather than with any other group such as that represented by the PF00097Musmu_Goliath sequence.

Preferably in one embodiment, the amino acid sequence encoded by the variant nucleic acid obtained by gene shuffling, when used in the construction of a phylogenetic tree such as the one depicted in FIG. 21, clusters with the Group 1, comprising the amino acid sequence represented by SEQ ID NO: 409 rather than with the YTP polypeptides in Group 2.

Furthermore, nucleic acid sequence variants may also be obtained by site-directed mutagenesis. Several methods are available to achieve site-directed mutagenesis, the most common being PCR based methods (Current Protocols in Molecular Biology. Wiley Eds.).

Nucleic acid sequences encoding GRF polypeptides may be derived from any natural or artificial source. The nucleic acid sequence may be modified from its native form in composition and/or genomic environment through deliberate human manipulation. Preferably the nucleic acid sequence encoding a GRF polypeptide is from a plant, further preferably from a dicotyledonous plant, more preferably from the family Brassicaceae, most preferably the nucleic acid sequence is from *Arabidopsis thaliana*.

Nucleic acids encoding RAA1-like polypeptides may be derived from any natural or artificial source. The nucleic acid may be modified from its native form in composition and/or genomic environment through deliberate human manipulation. Preferably the RAA1-like polypeptide-encoding nucleic acid is from a plant, further preferably from a monocotyledonous plant, more preferably from the family Poaceae, most preferably the nucleic acid is from *Oryza sativa*.

Nucleic acids encoding SYR polypeptides may be derived from any natural or artificial source. The nucleic acid may be modified from its native form in composition and/or genomic environment through deliberate human manipulation. Preferably the SYR polypeptide-encoding nucleic acid is from a plant, further preferably from a monocotyledonous plant, more preferably from the family Poaceae, most preferably the nucleic acid is from *Oryza sativa*.

Nucleic acids encoding ARKL polypeptides may be derived from any natural or artificial source. The nucleic acid may be modified from its native form in composition and/or genomic environment through deliberate human manipulation. Preferably the ARKL polypeptide-encoding nucleic acid is from a plant, further preferably from a monocotyledonous plant, more preferably from the family Poaceae, most preferably the nucleic acid is from *Oryza sativa*.

Nucleic acids encoding YTP polypeptides may also be encoded by a de novo designed YTP polypeptide, i.e. not derived from a natural source. The nucleic acid may be modified from its native form in composition and/or genomic environment through deliberate human manipulation. Preferably the YTP polypeptide-encoding nucleic acid is from a plant, further preferably from a monocotyledonous plant, more preferably from the family Poaceae, most preferably the nucleic acid is from *Oryza sativa*.

Performance of the methods of the invention gives in one embodiment plants having enhanced yield-related traits. In particular performance of the methods of the invention gives plants having increased yield, especially increased seed yield relative to control plants. The terms "yield" and "seed yield" are described in more detail in the "definitions" section herein.

Performance of the methods of the invention gives in one embodiment plants having increased abiotic stress resistance (or abiotic stress tolerance, which terms are used interchangeably), effected as enhanced yield-related traits compared to control plants when grown under abiotic stress. In particular, performance of the methods of the invention gives plants having increased yield, especially increased seed yield and increased biomass relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground.

In one embodiment, such harvestable parts are seeds, and performance of the methods of the invention results in plants having increased seed yield relative to the seed yield of control plants.

In one embodiment such harvestable parts are roots, flowers and/or seeds, and performance of the methods of the invention results in plants having increased biomass and/or seed yield relative to the seed yield of control plants.

In one embodiment, such harvestable parts are seeds, and performance of the methods of the invention results in plants having increased yield, total seed weight, seed filling rate, number of flowers (or florets), harvest index, and thousand kernel weight relative to control plants.

Taking corn as an example, a yield increase may be manifested as one or more of the following: increase in the number of plants established per hectare or acre, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per hectare or acre, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield-related traits of plants relative to control plants, which method comprises increasing expression in a plant of a nucleic acid sequence encoding a polypeptide selected from the group consisting of: GRF polypeptide and RAA1-like polypeptide polypeptide respectively as defined herein.

The present invention provides a method for increasing abiotic stress resistance of plants, resulting in increased yield, especially seed yield and/or increased biomass of plants, relative to control plants, when grown under conditions of abiotic stress, which method comprises modulating expression, preferably increasing expression, in a plant of a nucleic acid encoding a SYR polypeptide as defined herein.

The present invention provides a method for increasing yield, especially seed yield of plants, relative to control plants, which method comprises modulating expression in a plant of a nucleic acid encoding an ARKL polypeptide as defined herein.

The present invention provides a method for increasing yield, especially seed yield of plants, relative to control plants, which method comprises modulating expression in a plant of a nucleic acid encoding a YTP polypeptide as defined herein.

Since the transgenic plants according to the present invention have increased yield-related traits, it is likely that these plants exhibit an increased growth rate (during at least part of their life cycle), relative to the growth rate of control plants at a corresponding stage in their life cycle.

Besides the increased yield capacity, an increased efficiency of nutrient uptake may also contribute to the increase in yield. It is observed that the plants according to the present invention show a higher efficiency in nutrient uptake. Increased efficiency of nutrient uptake allows better growth of the plant, when the plant is under stress. It is also observed that the transgenic plants according to the present invention have increased drought stress tolerance, allowing the plants to continue growing under conditions that retard or inhibit growth of control plants.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect increased (early) vigour. The increase in growth rate may alter the harvest cycle of a plant allowing plants to be sown later and/or harvested sooner than would otherwise be possible (a similar effect may be obtained with earlier flowering time; delayed flowering is usually not a desirede trait in crops). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per acre (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises increasing expression in a plant of a nucleic acid sequence encoding a GRF polypeptide or a RAA1-like polypeptide or a YTP polypeptide or a ARKL polypeptide as defined herein.

According to a preferred feature of the present invention, performance of the methods of the invention gives plants having an increased growth rate relative to control plants when grown under abiotic stress conditions. Therefore, according to the present invention, there is provided a method for increasing the growth rate of plants under abiotic stress conditions, which method comprises modulating expression, preferably increasing expression, in a plant of a nucleic acid encoding a SYR polypeptide as defined herein.

Increased yield-related traits occur whether the plant is under non-stress conditions or whether the plant is exposed to various stresses compared to control plants grown under comparable conditions. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed.

Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes, and insects. The term "non-stress" conditions as used herein are those environmental conditions that allow optimal growth of plants. Persons skilled in the art are aware of normal soil conditions and climatic conditions for a given location.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi and insects.

Performance of the methods of the invention gives in one embodiment plants grown under non-stress conditions or under mild stress conditions having increased yield-related traits, relative to control plants grown under comparable conditions. Therefore, according to the present invention, there is provided a method for increasing yield-related traits in plants grown under non-stress conditions or under mild stress conditions, which method comprises increasing expression in a plant of a nucleic acid sequence encoding a GRF polypeptide.

Performance of the methods according to the present invention results in plants grown under abiotic stress conditions having increased yield-related traits relative to control plants grown under comparable stress conditions. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. Since diverse environmental stresses activate similar pathways, the exemplification of the present invention with drought stress should not be seen as a limitation to drought stress, but more as a screen to indicate the involvement of GRF polypeptides as defined above, in increasing yield-related traits relative to control plants grown in comparable stress conditions, in abiotic stresses in general.

The term "abiotic stress" as defined herein is taken to mean any one or more of: water stress (due to drought or excess water), anaerobic stress, salt stress, temperature stress (due to hot, cold or freezing temperatures), chemical toxicity stress and oxidative stress. According to one aspect of the invention, the abiotic stress is an osmotic stress, selected from water stress, salt stress, oxidative stress and ionic stress. Preferably, the water stress is drought stress. The term salt stress is not restricted to common salt (NaCl), but may be any stress caused by one or more of: NaCl, KCl, LiCl, $MgCl_2$, $CaCl_2$, amongst others.

Performance of the methods of the invention gives plants having increased yield-related traits, under abiotic stress conditions relative to control plants grown in comparable stress conditions. Therefore, according to the present invention, there is provided a method for increasing yield-related traits, in plants grown under abiotic stress conditions, which method comprises increasing expression in a plant of a nucleic acid sequence encoding a GRF polypeptide. According to one aspect of the invention, the abiotic stress is an osmotic stress, selected from one or more of the following: water stress, salt stress, oxidative stress and ionic stress.

Another example of abiotic environmental stress is the reduced availability of one or more nutrients that need to be assimilated by the plants for growth and development. Because of the strong influence of nutrition utilization efficiency on plant yield and product quality, a huge amount of fertilizer is poured onto fields to optimize plant growth and quality. Productivity of plants ordinarily is limited by three primary nutrients, phosphorous, potassium and nitrogen, which is usually the rate-limiting element in plant growth of these three. Therefore the major nutritional element required for plant growth is nitrogen (N). It is a constituent of numerous important compounds found in living cells, including amino acids, proteins (enzymes), nucleic acids, and chlorophyll. 1.5% to 2% of plant dry matter is nitrogen and approximately 16% of total plant protein. Thus, nitrogen availability is a major limiting factor for crop plant growth and production (Frink et al. (1999) Proc Natl Acad Sci USA 96(4): 1175-1180), and has as well a major impact on protein accumulation and amino acid composition. Therefore, of great interest are crop plants with increased yield-related traits, when grown under nitrogen-limiting conditions.

Performance of the methods of the invention gives plants grown under conditions of reduced nutrient availability, particularly under conditions of reduced nitrogen availablity, having increased yield-related traits relative to control plants grown under comparable conditions. Therefore, according to the present invention, there is provided a method for increasing yield-related traits in plants grown under conditions of reduced nutrient availablity, preferably reduced nitrogen availability, which method comprises increasing expression in a plant of a nucleic acid sequence encoding a GRF polypeptide. Reduced nutrient availability may result from a deficiency or excess of nutrients such as nitrogen, phosphates and other phosphorous-containing compounds, potassium, calcium, cadmium, magnesium, manganese, iron and boron, amongst others. Preferably, reduced nutrient availablity is reduced nitrogen availability.

Performance of the methods of the invention gives in one embodiment plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding a RAA1-like polypeptide.

Performance of the methods of the invention gives in one embodiment plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a RAA1-like polypeptide. Nutrient deficiency may result from a lack of nutrients such as nitrogen, phosphates and other phosphorous-containing compounds, potassium, calcium, cadmium, magnesium, manganese, iron and boron, amongst others.

Performance of the methods of the invention gives plants grown under abiotic stress conditions such as mild to severe drought conditions increased yield relative to control plants grown under comparable conditions. Therefore, according to the present invention, there is provided a method for increasing yield in plants grown under abiotic stress conditions such as mild to severe drought conditions, which method comprises increasing expression in a plant of a nucleic acid encoding a SYR polypeptide. The term "severe drought conditions" or "severe drought stress" as used herein are those drought conditions that cause a yield reduction of 50% or more in the control plants, compared to the yield of control plants grown under non-stress conditions.

Performance of the methods of the invention gives in one embodiment plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises increasing expression in a plant of a nucleic acid encoding a SYR polypeptide. Nutrient deficiency may result from a lack of nutrients such as nitrogen, phosphates and other phosphorous-containing compounds, potassium, calcium, cadmium, magnesium, manganese, iron and boron, amongst others.

Performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding an ARKL polypeptide.

Performance of the methods of the invention gives in one embodiment plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding an ARKL polypeptide. Nutrient deficiency may result from a lack of nutrients such as nitrogen, phosphates and other phosphorous-containing compounds, potassium, calcium, cadmium, magnesium, manganese, iron and boron, amongst others.

Performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding a YTP polypeptide.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a YTP polypeptide. Nutrient deficiency may result from a lack of nutrients such as nitrogen, phosphates and other phosphorous-containing compounds, potassium, calcium, cadmium, magnesium, manganese, iron and boron, amongst others.

The present invention encompasses plants or parts thereof (including seeds) or cells thereof obtainable by the methods according to the present invention. The plants or parts thereof or cells thereof comprise a nucleic acid transgene encoding a polypeptide selected from the group consisting of: GRF polypeptide, RAA1-like polypeptide, SYR polypeptide, ARKL polypeptide, and YTP polypeptide respectively as defined above.

The invention also provides genetic constructs and vectors to facilitate introduction and/or increased expression in plants of nucleic acid sequences encoding a polypeptide selected from the group consisting of: GRF polypeptide, RAA1-like polypeptide, SYR polypeptide, ARKL polypeptide, and YTP polypeptide respectively. The gene constructs may be inserted into vectors, which may be commercially available, suitable for transforming into plants and for expression of the gene of interest in the transformed cells. The invention also provides use of a gene construct as defined herein in the methods of the invention.

More specifically, the present invention provides in one embodiment a construct comprising:
 (a) a nucleic acid sequence encoding a GRF polypeptide as defined above;
 (b) one or more control sequences capable of increasing expression of the nucleic acid sequence of (a); and optionally
 (c) a transcription termination sequence.

Preferably, the nucleic acid sequence encoding a GRF polypeptide is as defined above. The term "control sequence" and "termination sequence" are as defined herein.

Preferably, one of the control sequences of a construct is a constitutive promoter isolated from a plant genome. An example of a plant constitutive promoter is a GOS2 promoter, preferably a rice GOS2 promoter, more preferably a GOS2 promoter as represented by SEQ ID NO: 117.

More specifically, the present invention provides in one embodiment a construct comprising:
 (d) a nucleic acid encoding a RAA1-like polypeptide as defined above;
 (e) one or more control sequences capable of driving expression of the nucleic acid sequence of (a); and optionally
 (f) a transcription termination sequence.

Preferably, the nucleic acid encoding a RAA1-like polypeptide is as defined above. The term "control sequence" and "termination sequence" are as defined herein.

More specifically, the present invention provides in one embodiment a construct comprising:
 1. a nucleic acid encoding a SYR polypeptide as defined above;
 2. one or more control sequences capable of driving expression of the nucleic acid sequence of (a); and optionally
 3. a transcription termination sequence.

Preferably, the nucleic acid encoding a SYR polypeptide is as defined above. The term "control sequence" and "termination sequence" are as defined herein.

More specifically, the present invention provides in one embodiment a construct comprising:
 1. a nucleic acid encoding an ARKL polypeptide as defined above;
 2. one or more control sequences capable of driving expression of the nucleic acid sequence of (a); and optionally
 3. a transcription termination sequence.

Preferably, the nucleic acid encoding an ARKL polypeptide is as defined above. The term "control sequence" and "termination sequence" are as defined herein.

More specifically, the present invention provides in one embodiment a construct comprising:
 1. a nucleic acid encoding a YTP polypeptide as defined above;
 2. one or more control sequences capable of driving expression of the nucleic acid sequence of (a); and optionally
 3. a transcription termination sequence.

Preferably, the nucleic acid encoding a YTP polypeptide is as defined above. The term "control sequence" and "termination sequence" are as defined herein.

Plants are transformed with a vector comprising any of the nucleic acid sequences described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter, whether natural or synthetic, may be used to increase expression of the nucleic acid sequence. A constitutive promoter is particularly useful in the methods, preferably a constitutive promoter isolated from a plant genome. The plant constitutive promoter drives expression of a coding sequence at a level that is in all instances below that obtained under the control of a 35S CaMV viral promoter.

Other organ-specific promoters, for example for preferred expression in leaves, stems, tubers, meristems, seeds (embryo and/or endosperm), are useful in performing the methods of the invention. See the "Definitions" section herein for definitions of the various promoter types.

Preferably in one embodiment the constitutive promoter is also a ubiquitous promoter. See the "Definitions" section herein for definitions of the various promoter types.

It should be clear that the applicability of the present invention is not restricted to a nucleic acid sequence encoding the GRF polypeptide, as represented by SEQ ID NO: 1, nor is the applicability of the invention restricted to expression of a GRF polypeptide-encoding nucleic acid sequence when driven by a constitutive promoter.

It should be clear that the applicability of the present invention is not restricted to the RAA1-like polypeptide-encoding nucleic acid represented by SEQ ID NO: 120, nor is the applicability of the invention restricted to expression of a RAA1-like polypeptide-encoding nucleic acid when driven by a constitutive promoter.

The constitutive promoter is preferably a GOS2 promoter, preferably a GOS2 promoter from rice. Further preferably the constitutive promoter is represented by a nucleic acid sequence substantially similar to SEQ ID NO: 124, most preferably the constitutive promoter is as represented by SEQ ID NO: 124 or SEQ ID NO: 211. According to another preferred feature of the invention, the constitutive promoter is a High Mobility Group Protein (HMGP) promoter, preferably a HMGP promoter from rice, more preferably substantially similar to SEQ ID NO: 125, most preferably identical to SEQ ID NO: 125. See Table 2 in the "Definitions" section herein for further examples of constitutive promoters.

It should be clear that the applicability of the present invention is not restricted to the SYR polypeptide-encoding nucleic acid represented by SEQ ID NO: 168, nor is the applicability of the invention restricted to expression of a SYR polypeptide-encoding nucleic acid when driven by a constitutive promoter.

The constitutive promoter is preferably a GOS2 promoter, preferably a GOS2 promoter from rice. Further preferably the constitutive promoter is represented by a nucleic acid sequence substantially similar to SEQ ID NO: 172 or SEQ ID NO: 211, most preferably the constitutive promoter is as represented by SEQ ID NO: 172 or SEQ ID NO: 211. See Table 2 in the "Definitions" section herein for further examples of useful constitutive promoters.

It should be clear that the applicability of the present invention is not restricted to the ARKL polypeptide-encoding nucleic acid represented by SEQ ID NO: 212, nor is the applicability of the invention restricted to expression of an ARKL polypeptide-encoding nucleic acid when driven by a constitutive promoter, or when driven by a root-specific promoter.

The constitutive promoter is preferably a GOS2 promoter, preferably a GOS2 promoter from rice. Further preferably the constitutive promoter is represented by a nucleic acid sequence substantially similar to SEQ ID NO: 406, most preferably the constitutive promoter is as represented by SEQ ID NO: 406 or SEQ ID NO: 211. See Table 2 in the "Definitions" section herein for further examples of constitutive promoters.

It should be clear that the applicability of the present invention is not restricted to the YTP polypeptide-encoding nucleic acid represented by SEQ ID NO: 1, nor is the applicability of the invention restricted to expression of a YTP polypeptide-encoding nucleic acid when driven by a constitutive promoter.

The constitutive promoter is preferably a GOS2 promoter, preferably a GOS2 promoter from rice. Further preferably the constitutive promoter is represented by a nucleic acid sequence substantially similar to SEQ ID NO: 548, most preferably the constitutive promoter is as represented by SEQ ID NO: 548 or SEQ ID NO: 211. See Table 2 in the "Definitions" section herein for further examples of constitutive promoters.

Optionally, one or more terminator sequences may be used in the construct introduced into a plant. Additional regulatory elements may include transcriptional as well as translational increasers. Those skilled in the art will be aware of terminator and increaser sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, increaser, silencer, intron sequences, 3'UTR and/or 5'UTR regions) may be protein and/or RNA stabilizing elements. Such sequences would be known or may readily be obtained by a person skilled in the art.

Optionally, one or more terminator sequences may be used in the construct introduced into a plant. Preferably, the construct comprises an expression cassette essentially similar or identical to SEQ ID NO: 166, comprising the GOS2 promoter, the nucleic acid encoding the RAA1-like polypeptide. In an alternative embodiment, the construct comprises an expression cassette essentially similar or identical to SEQ ID NO: 167, comprising the HMGP promoter, the nucleic acid encoding the RAA1-like polypeptide.

Optionally, one or more terminator sequences may be used in the construct introduced into a plant. Preferably, the construct comprises an expression cassette essentially similar or identical to SEQ ID NO: 407, comprising the GOS2 promoter, the nucleic acid encoding the Orysa_ARKL1 polypeptide and the T-zein+T-rubisco transcription terminator sequence.

Optionally, one or more terminator sequences may be used in the construct introduced into a plant. Preferably, the construct comprises an expression cassette essentially similar or identical to SEQ ID NO 549, comprising the GOS2 promoter, the nucleic acid encoding the YTP polypeptide and the T-zein+T-rubisco transcription terminator sequence.

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-on and colE1.

For the detection of the successful transfer of the nucleic acid sequences as used in the methods of the invention and/or selection of transgenic plants comprising these nucleic acid sequences, it is advantageous to use marker genes (or reporter genes). Therefore, the genetic construct may optionally comprise a selectable marker gene. Selectable markers are described in more detail in the "definitions" section herein.

The marker genes may be removed or excised from the transgenic cell once they are no longer needed. Techniques for marker removal are known in the art, useful techniques are described above in the definitions section.

It is known that upon stable or transient integration of nucleic acid sequences into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid sequence molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid sequence can be identified for example by selection (for example, cells which have integrated the selectable marker survive whereas the other cells die). The marker genes may be removed or excised from the transgenic cell once they are no longer needed. Techniques for marker gene removal are known in the art, useful techniques are described above in the definitions section.

The invention also provides a method for the production of transgenic plants having increased yield-related traits relative to control plants, comprising introduction and expression in a plant of any nucleic acid sequence encoding a polypeptide selected from the group consisting of: GRF polypeptide, RAA1-like polypeptide, SYR polypeptide, ARKL polypeptide, and YTP polypeptide respectively as defined hereinabove.

More specifically, the present invention provides in one embodiment a method for the production of transgenic plants having increased yield-related traits relative to control plants, which method comprises:
 (i) introducing and expressing in a plant, plant part, or plant cell a nucleic acid sequence encoding a GRF polypeptide, under the control of plant constitutive promoter; and
 (ii) cultivating the plant cell, plant part or plant under conditions promoting plant growth and development.

The nucleic acid sequence of (i) may be any of the nucleic acid sequences capable of encoding a GRF polypeptide as defined herein.

More specifically, the present invention provides in one embodiment a method for the production of transgenic plants having increased enhanced yield-related traits, particularly increased biomass and/or seed yield, which method comprises:
 i) introducing and expressing in a plant or plant cell a RAA1-like polypeptide-encoding nucleic acid; and
 ii) cultivating the plant cell under conditions promoting plant growth and development.

The nucleic acid of (i) may be any of the nucleic acids capable of encoding a RAA1-like polypeptide as defined herein.

More specifically, the present invention provides in one embodiment a method for the production of transgenic plants having increased enhanced yield-related traits, particularly increased (seed) yield and/or increased biomass, which method comprises:
 (i) introducing and expressing in a plant or plant cell a SYR polypeptide-encoding nucleic acid; and
 (ii) cultivating the plant cell under conditions promoting plant growth and development.

The nucleic acid of (i) may be any of the nucleic acids capable of encoding a SYR polypeptide as defined herein.

More specifically, the present invention provides in one embodiment a method for the production of transgenic plants having increased enhanced yield-related traits, particularly increased (seed) yield, which method comprises:
 (i) introducing and expressing in a plant or plant cell an ARKL polypeptide-encoding nucleic acid; and
 (ii) cultivating the plant cell under conditions promoting plant growth and development.

The nucleic acid of (i) may be any of the nucleic acids capable of encoding an ARKL polypeptide as defined herein.

More specifically, the present invention provides in one embodiment a method for the production of transgenic plants having increased enhanced yield-related traits, particularly increased (seed) yield, which method comprises:
 i) introducing and expressing in a plant or plant cell a YTP polypeptide-encoding nucleic acid; and
 ii) cultivating the plant cell under conditions promoting plant growth and development.

The nucleic acid of (i) may be any of the nucleic acids capable of encoding a YTP polypeptide as defined herein.

The nucleic acid sequence may be introduced directly into a plant cell or into the plant itself (including introduction into a tissue, organ or any other part of a plant). According to a preferred feature of the present invention, the nucleic acid sequence is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid sequence encoding a polypeptide selected from the group consisting of: GRF polypeptide, RAA1-like polypeptide, SYR polypeptide, ARKL polypeptide, and YTP polypeptide respectively as defined hereinabove, opereably linked to a plant constitutive promoter. Preferred host cells according to the invention are plant cells. Host plants for the nucleic acid sequences or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants, which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, *triticale, sorghum*, emmer, spelt, *secale*, einkorn, teff, milo and oats.

The invention also extends to harvestable parts of a plant comprising an isolated nucleic acid sequence encoding a polypeptide selected from the group consisting of: GRF polypeptide, RAA1-like polypeptide, SYR polypeptide, ARKL polypeptide, and YTP polypeptide respectively (as defined hereinabove) operably linked to a plant constitutive promoter, such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and examples are provided in the definitions section.

As mentioned above, a preferred method for increasing expression of a nucleic acid sequence encoding a polypeptide selected from the group consisting of: GRF polypeptide, RAA1-like polypeptide, SYR polypeptide, ARKL polypeptide, and YTP polypeptide respectively is by introducing and expressing in a plant a nucleic acid sequence encoding a polypeptide selected from the group consisting of: GRF polypeptide, RAA1-like polypeptide, SYR polypeptide, ARKL polypeptide, and YTP polypeptide respectively; however the effects of performing the method, i.e. increasing yield-related traits, may also be achieved using other well known techniques, including but not limited to T-DNA activation tagging, TILLING, homologous recombination. A description of these techniques is provided in the definitions section.

The present invention also encompasses in one embodiment use of nucleic acid sequences encoding GRF polypeptides as described herein and use of these GRF polypeptides in increasing any of the aforementioned yield-related traits in plants, under normal growth conditions, under abiotic stress growth (preferably osmotic stress growth conditions) conditions, and under growth conditions of reduced nutrient availability, preferably under conditions of reduced nitrogen availability.

The present invention also encompasses in one embodiment use of nucleic acids encoding RAA1-like polypeptides as described herein and use of these RAA1-like polypeptides in enhancing any of the aforementioned yield-related traits in plants.

The present invention also encompasses in one embodiment use of nucleic acids encoding SYR polypeptides as described herein and use of these SYR polypeptides in enhancing any of the aforementioned yield-related traits in plants when grown under abiotic stress conditions.

The present invention also encompasses in one embodiment use of nucleic acids encoding ARKL polypeptides as described herein and use of these ARKL polypeptides in enhancing any of the aforementioned yield-related traits in plants.

The present invention also encompasses in one embodiment use of nucleic acids encoding YTP polypeptides as described herein and use of these YTP polypeptides in enhancing any of the aforementioned yield-related traits in plants.

Nucleic acid sequences encoding a polypeptide selected from the group consisting of: GRF polypeptide, RAA1-like polypeptide, SYR polypeptide, ARKL polypeptide, and YTP polypeptide respectively, described herein, or the polypeptides of the invention themselves, may find use in breeding programmes in which a DNA marker is identified that may be genetically linked to a GRF polypeptide-encoding gene. The genes/nucleic acid sequences, or the GRF polypeptide, RAA1-like polypeptide, SYR polypeptide, ARKL polypeptide, and YTP polypeptide respectively, themselves may be used to define a molecular marker. This DNA or protein marker may then be used in breeding programmes to select plants having increased yield-related traits, as defined hereinabove in the methods of the invention.

Allelic variants of a gene/nucleic acid sequence encoding a polypeptide selected from the group consisting of: GRF polypeptide, RAA1-like polypeptide, SYR polypeptide, ARKL polypeptide, and YTP polypeptide respectively may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield-related traits. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acid sequences encoding polypeptide selected from the group consisting of: GRF polypeptide, RAA1-like polypeptide, SYR polypeptide, ARKL polypeptide, and YTP polypeptide respectively may also be used as probes for genetically and physically mapping the genes that they are a part of, and as markers for traits linked to those genes. Such information may be useful in plant breeding in order to develop lines with desired phenotypes. Such use of nucleic acid sequences encoding a polypeptide selected from the group consisting of: GRF polypeptide, RAA1-like polypeptide, SYR polypeptide, ARKL polypeptide, and YTP polypeptide respectively requires only a nucleic acid sequence of at least 15 nucleotides in length. The nucleic acid sequences encoding a polypeptide selected from the group consisting of: GRF polypeptide, RAA1-like polypeptide, SYR polypeptide, ARKL polypeptide, and YTP polypeptide respectively may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acid sequences encoding a polypeptide selected from the group consisting of: GRF polypeptide, RAA1-like polypeptide, SYR polypeptide, ARKL polypeptide, and YTP polypeptide respectively. The resulting banding patterns may then be subjected to genetic analyses using computer programs such as MapMaker (Lander et al. (1987) Genomics 1: 174-181) in order to construct a genetic map. In addition, the nucleic acid sequences may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid sequence encoding a GRF polypeptide in the genetic map previously obtained using this population (Botstein et al. (1980) Am. J. Hum. Genet. 32: 314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid sequence probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid sequence probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid sequence amplification-based methods for genetic and physical mapping may be carried out using the nucleic acid sequences. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic acid sequence Res. 18:3671), Radiation Hybrid Mapping (Walter et al. (1997) Nat. Genet. 7:22-28) and Happy Mapping (Dear and Cook (1989) Nucleic acid sequence Res. 17:6795-6807). For these methods, the sequence of a nucleic acid sequence is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in one embodiment in plants having increased yield-related traits, as described hereinbefore. These traits may also be combined with other economically advantageous traits, such as further yield-increasing traits, tolerance to abiotic and biotic stresses, tolerance to herbicides, insecticides, traits modifying various architectural features and/or biochemical and/or physiological features.

The methods according to the present invention result in one embodiment in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

Methods for gene stacking in transgenic plants are well known in the art (see for example, a review by Halpin (2005) Plant Biotech J (3): 141-155. Gene stacking can proceed by interative steps, where two or more transgenes can be sequentially introduced into a plant by crossing a plant containing one transgene with individuals harbouring other transgenes or, alternatively, by re-transforming (or supertransforming) a plant containing one transgene with new genes. One limitation of the iterative procedure is that the transgenes are not linked and will be located at different random loci in the plant genome. The consequence is that the two loci can segregate apart in subsequent generations, which has consequences for breeding programs.

Alternatively, gene stacking can occur via co-transformation, which is faster and can be used in a whole range of transformation techniques. When using *Agrobacterium* transformation for example, the transgenes (at least two) can be present in a number of conformations:

(i) the coding sequences are fused to form a single polypeptide when translated, and placed under the control of a single promoter;

(ii) the coding sequences are sequentially placed downstream of a single promoter, separated by nucleic acid signals that influence mRNA synthesis (internal ribosome entry sites IRES, 2A stuttering signals, etc.), or polypeptide synthesis (polyproteins separated by protease substrate sites, etc.);

(iii) the coding sequences are independently driven by separate promoters, and the promoter-coding sequence combinations are located within the same T-DNA;

(iv) the coding sequences are independently driven by separate promoters, and the promoter-coding sequence combinations are located in different T-DNAs on the same plasmid;

(v) the coding sequences are independently driven by separate promoters, and the promoter-coding sequence combinations are located in different T-DNAs on different plasmids hosted in the same or in separate *Agrobacterium* strains.

In another embodiment, the present invention provides a method for increasing yield-related traits in plants relative to control plants, comprising increasing expression in a plant of a nucleic acid sequence encoding a GRF polypeptide and modulating expression in the same plant of a nucleic acid sequence encoding a second polypeptide Surprisingly, it has now been found that increasing expression in a plant of a nucleic acid sequence encoding a GRF polypeptide gives plants having increased yield-related traits relative to control plants. According to a first embodiment, the present invention provides a method for increasing yield-related traits in plants relative to control plants, comprising increasing expression in a plant of a nucleic acid sequence encoding a GRF polypeptide.

In one embodiment the invention relates to subject matter summarized as follows:

1. A method for increasing yield-related traits in plants relative to control plants, comprising increasing expression in a plant of a nucleic acid sequence encoding a Growth-Regulating Factor (GRF) polypeptide, which GRF polypeptide comprises; (i) a domain having at least 50%, 55%, 60%, 65%, 70%, 75%, 80%, 85%, 90%, 95%, 98%, 99% or more amino acid sequence identity to a QLQ domain as represented by SEQ ID NO: 115; and (ii) a domain having at least 50%, 55%, 60%, 65%, 70%, 75%, 80%, 85%, 90%, 95%, 98%, 99% or more amino acid sequence identity to a WRC domain as represented by SEQ ID NO: 116, and optionally selecting for plants having increased yield-related traits.
2. Method according to item 1, wherein said GRF polypeptide comprises: (i) a QLQ domain with an InterPro accession IPR014978 (PFAM accession PF08880); (ii) a WRC domain with an InterPro accession IPR014977 (PFAM accession PF08879); and (iii) an Effector of Transcription (ET) domain comprising three Cys and one His residues in a conserved spacing ($CX_9CX_{10}CX_2H$).
3. Method according to item 1 or 2, wherein said GRF polypeptide has in increasing order of preference at least 50%, 55%, 60%, 65%, 70%, 75%, 80%, 85%, 90%, 95%, 98%, 99% or more amino acid sequence identity to the GRF polypeptide as represented by SEQ ID NO: 2 or to any of the polypeptide sequences given in Table A herein.
4. Method according to any preceding item, wherein said nucleic acid sequence encoding a GRF polypeptide is represented by any one of the nucleic acid sequence SEQ ID NOs given in Table A or a portion thereof, or a sequence capable of hybridising with any one of the nucleic acid sequences SEQ ID NOs given in Table A.
5. Method according to any preceding item, wherein said nucleic acid sequence encodes an orthologue or paralogue of any of the polypeptide sequence SEQ ID NOs given in Table A.
6. Method according to any preceding item, wherein said increased expression is effected by any one or more of: T-DNA activation tagging, TILLING, or homologous recombination.
7. Method according to any preceding item, wherein said increased expression is effected by introducing and expressing in a plant a nucleic acid sequence encoding a GRF polypeptide.
8. Method according to any preceding item, wherein said increased yield-related trait is one or more of: (i) increased early vigour; (ii) increased aboveground biomass; (iii) increased total seed yield per plant; (iv) increased seed filling rate; (v) increased harvest index; or (vi) increased thousand kernel weight (TKW).
9. Method according to any preceding item, wherein said nucleic acid sequence is operably linked to a constitutive promoter, preferably to a plant constitutive promoter, more preferably to a GOS2 promoter, most preferably to a GOS2 promoter from rice as represented by SEQ ID NO: 117.
10. Method according to any preceding item, wherein said nucleic acid sequence encoding a GRF polypeptide is of plant origin, preferably from a dicotyledonous plant, further preferably from the family Brassicaceae, most preferably from *Arabidopsis thaliana*.
11. Plants, parts thereof (including seeds), or plant cells obtainable by a method according to any preceding item, wherein said plant, part or cell thereof comprises an isolated nucleic acid transgene encoding a GRF polypeptide operably linked to a plant constitutive promoter.
12. Construct comprising:
    1. A nucleic acid sequence encoding a GRF polypeptide as defined in any one of items 1 to 5;
    2. one or more control sequences capable of driving expression of the nucleic acid sequence of (a); and optionally
    3. a transcription termination sequence.
13. Construct according to item 12, wherein said control sequence is a plant constitutive promoter, preferably a GOS2 promoter, more preferably a GOS2 promoter as represented by SEQ ID NO: 117.
14. Use of a construct according to items 12 or 13 in a method for making plants having increased yield-related traits relative to control plants, which increased yield-related traits are one or more of: (i) increased early vigour; (ii) increased aboveground biomass; (iii) increased total seed yield per plant; (iv) increased seed filling rate; (v) increased harvest index; or (vi) increased thousand kernel weight (TKW).
15. Plant, plant part or plant cell transformed with a construct according to item 12 or 13.
16. Method for the production of transgenic plants having increased yield-related traits relative to control plants, comprising:
    (i) introducing and expressing in a plant, plant part, or plant cell, a nucleic acid sequence encoding a GRF polypeptide as defined in any one of items 1 to 5, under the control of plant constitutive promoter; and
    (ii) cultivating the plant cell, plant part, or plant under conditions promoting plant growth and development.
17. Transgenic plant having increased yield-related traits relative to control plants, resulting from increased expression of a nucleic acid sequence encoding a GRF polypeptide as defined in any one of items 1 to 5, operably linked to a plant constitutive promoter, or a transgenic plant cell or transgenic plant part derived from said transgenic plant.
18. Transgenic plant according to item 11, 15 or 17, wherein said plant is a crop plant or a monocot or a cereal, such as rice, maize, wheat, barley, millet, rye, *triticale, sorghum* and oats, or a transgenic plant cell derived from said transgenic plant.
19. Harvestable parts comprising an isolated nucleic acid sequence encoding a GRF polypeptide of a plant according to item 18, wherein said harvestable parts are preferably seeds.
20. Products derived from a plant according to item 18 and/or from harvestable parts of a plant according to item 19.
21. Use of a nucleic acid sequence encoding a GRF polypeptide as defined in any one of items 1 to 5 in increasing yield-related traits, comprising one or more of: (i) increased early vigour; (ii) increased aboveground biomass; (iii) increased total seed yield per plant; (iv) increased seed filling rate; (v) increased harvest index; or (vi) increased thousand kernel weight (TKW).

In one embodiment the invention relates to subject matter summarized as follows:

22. A method for enhancing yield-related traits in plants relative to control plants, comprising modulating expression in a plant of a nucleic acid encoding a RAA1-like polypeptide, wherein said RAA1-like polypeptide comprises two or more of the following motifs:

```
(i) motif 1:      GVW(V/L)F,                      (SEQ ID NO: 162)

(ii) motif 2:     LGW(E/S)RY(Y/F),                (SEQ ID NO: 163)

(iii) motif 3:    (D/H)L(L/I)S(I/V/L)P(R/K/A)(S/D)F,  (SEQ ID NO: 164)

(iv) motif 4:     (H/Y)(F/M)YD(V/I)VVK(N/T)(R/P), (SEQ ID NO: 165)
```

23. Method according to item 22, wherein said RAA1-like polypeptide furthermore has a MW between 10 and 21 KDa and a pI above 8.5.
24. Method according to item 22 or 23, wherein said modulated expression is effected by introducing and expressing in a plant a nucleic acid encoding a RAA1-like polypeptide.
25. Method according to any preceding item, wherein said nucleic acid encoding a RAA1-like polypeptide encodes any one of the proteins listed in Table A or is a portion of such a nucleic acid, or a nucleic acid capable of hybridising with such a nucleic acid.
26. Method according to any preceding item, wherein said nucleic acid sequence encodes an orthologue or paralogue of any of the proteins given in Table A.
27. Method according to any preceding item, wherein said enhanced yield-related traits comprise increased yield, preferably increased biomass and/or increased seed yield relative to control plants.
28. Method according to any one of items 22 to 27, wherein said enhanced yield-related traits are obtained under non-stress conditions.
29. Method according to any one of items 22 to 27, wherein said enhanced yield-related traits are obtained under conditions of nitrogen deficiency.
30. Method according to any one of items 24 to 29, wherein said nucleic acid is operably linked to a constitutive promoter
31. Method according to item 30, wherein said constitutive promoter is a GOS2 promoter or an HMGP promoter, preferably a GOS2 promoter or HMGP promoter from rice.
32. Method according to any preceding item, wherein said nucleic acid encoding a RAA1 polypeptide is of plant origin, preferably from a dicotyledonous plant, further preferably from the family Poaceae, more preferably from the genus *Oryza*, most preferably from *Oryza sativa*.
33. Plant or part thereof, including seeds, obtainable by a method according to any preceding item, wherein said plant or part thereof comprises a recombinant nucleic acid encoding a RAA1-like polypeptide.
34. Construct comprising:
    (i) nucleic acid encoding a RAA1-like polypeptide;
    (ii) one or more control sequences capable of driving expression of the nucleic acid sequence of (a); and optionally
    (iii) a transcription termination sequence.
35. Construct according to item 34, wherein one of said control sequences is a constitutive promoter.
36. Construct according to item 35, wherein said constitutive promoter is a GOS2 promoter or an HMGP promoter, preferably a GOS2 promoter or an HMGP promoter from rice.
37. Use of a construct according to any of items 34 to 36 in a method for making plants having increased yield, particularly increased biomass and/or increased seed yield relative to control plants.
38. Plant, plant part or plant cell transformed with a construct according to any of items 34 to 36.
39. Method for the production of a transgenic plant having increased yield, particularly increased biomass and/or increased seed yield relative to control plants, comprising:
    (i) introducing and expressing in a plant a nucleic acid encoding a RAA1-like polypeptide; and
    (ii) cultivating the plant cell under conditions promoting plant growth and development.
40. Transgenic plant having increased yield, particularly increased biomass and/or increased seed yield, relative to control plants, resulting from modulated expression of a nucleic acid encoding a RAA1-like polypeptide, or a transgenic plant cell derived from said transgenic plant.
41. Transgenic plant according to item 33, 38 or 39, or a transgenic plant cell derived thereof, wherein said plant is a crop plant or a monocot or a cereal, such as rice, maize, wheat, barley, millet, rye, *triticale, sorghum* and oats.
42. Harvestable parts of a plant according to item 41, wherein said harvestable parts are preferably root biomass and/or seeds.
43. Products derived from a plant according to item 41 and/or from harvestable parts of a plant according to 42.
44. Use of a nucleic acid encoding a RAA1-like polypeptide in increasing yield, particularly in increasing seed yield and/or root biomass in plants, relative to control plants.

In one embodiment the invention relates to subject matter summarized as follows:

45. A method for increasing abiotic stress resistance in plants relative to control plants, comprising modulating expression in a plant of a nucleic acid encoding a SYR polypeptide, which SYR polypeptide comprises a leucine rich domain, preceded by the conserved tripeptide motif 5 (one of SEQ ID NO: 173, 174, 175 or 176)) and followed by the conserved motif 6 (SEQ ID NO: 177), wherein said increased abiotic stress resistance is increased nutrient uptake efficiency and/or increased drought stress tolerance, relative to control plants.
46. Method according to item 45, wherein said SYR polypeptide has, in increasing order of preference, at least 27%, 30%, 35%, 40%, 45%, 50%, 55%, 60%, 65%, 70%, 75%, 80%, 85%, 90%, 95% or more sequence identity to the SYR polypeptide represented by SEQ ID NO: 169.
47. Method according to item 45 or 46, wherein said nucleic acid encoding a SYR polypeptide is represented by any one of the nucleic acid SEQ ID NOs given in Table A or a portion thereof, or a sequence capable of hybridising with any one of the nucleic acids SEQ ID NOs given in Table A.

48. Method according to any of items 45 to 47, wherein said nucleic acid sequence encodes an orthologue or paralogue of any of the SEQ ID NOs given in Table A.
49. Method according to any preceding item, wherein said SYR protein furthermore comprises the conserved motif 7 (SEQ ID NO: 178).
50. Method according to any preceding item, wherein said nutrient uptake efficiency results in increased seed yield and/or increased biomass.
51. Method of item 50, wherein said increased seed yield comprises at least increased total weight of seeds, Thousand Kernel Weight and/or increased number of filled seeds.
52. Method of item 50, wherein said increased biomass is increased shoot biomass and/or increased root biomass.
53. Method according to any preceding item, wherein said increased nutrient uptake efficiency occurs under mild drought conditions.
54. Method according to any preceding item, wherein said increased drought stress tolerance results in increased seed yield.
55. Method of item 54, wherein said increased seed yield comprises at least increased total weight of seeds, fillrate and/or Harvest Index.
56. Method according to any preceding item, wherein said modulated expression is effected by introducing and expressing in a plant a nucleic acid encoding a SYR polypeptide.
57. Method according to item 56, wherein said nucleic acid is operably linked to a constitutive promoter, preferably to a GOS2 promoter.
58. Method according to any preceding item, wherein said nucleic acid encoding a SYR polypeptide is of plant origin, preferably from a monocotyledonous plant, further preferably from the family Poaceae, more preferably from the genus *Oryza*, most preferably from *Oryza sativa*.
59. Use of a construct in a method for making plants having increased abiotic stress resistance, said construct comprising
    (a) nucleic acid encoding a SYR polypeptide as defined in any one of items 45 to 49;
    (b) one or more control sequences capable of driving expression of the nucleic acid sequence of (a); and optionally
    (c) a transcription termination sequence,
and wherein one of said control sequences is a constitutive promoter, preferably a GOS2 promoter and wherein said increased abiotic stress resistance is increased nutrient uptake efficiency and/or increased drought stress tolerance, relative to control plants.
60. Use of a nucleic acid encoding a SYR polypeptide in a method for increasing abiotic stress resistance in plants relative to control plants, wherein said increased abiotic stress resistance is increased nutrient uptake efficiency and/or increased drought stress tolerance, relative to control plants.
61. Use according to item 60, wherein said increased nutrient uptake efficiency results in increased seed yield and/or increased biomass.
62. Use according to item 60, wherein said increased drought stress tolerance results in increased seed yield.

In one embodiment the invention relates to subject matter summarized as follows:
63. A method for enhancing yield-related traits in plants relative to control plants, comprising modulating expression in a plant of a nucleic acid encoding an ARKL polypeptide.
64. Method according to item 63, wherein said ARKL polypeptide comprises one or more of the following domains:
    (i) A ZfC3H2C3 domain as represented by SEQ ID NO: 400 or a domain having in increasing order of preference at least 50%, 55%, 60%, 65%, 70%, 75%, 80%, 85%, 90%, 95% or more sequence identity to one or more of the ZfC3H2C3 domains as represented by SEQ ID NO: 95 to SEQ ID NO. 351; and
    (II) A DAR1 domain having in increasing order of preference at least 50%, 55%, 60%, 65%, 70%, 75%, 80%, 85%, 90%, 95% or more sequence identity to one or more of the PfamB2828 domains as represented by SEQ ID NO: 352 to SEQ ID NO. 398.
65. Method according to item 63 and 64, wherein said ARKL polypeptide comprises one or more of the following:
    (i) A ZfC3H2C3 domain as represented by SEQ ID NO: 401;
    (ii) A Motif 8 as represented by SEQ ID NO: 399;
66. Method according to item 63 to 65, wherein said modulated expression is effected by introducing and expressing in a plant a nucleic acid encoding an ARKL polypeptide.
67. Method according to any preceding item, wherein said nucleic acid encoding an ARKL polypeptide encodes any one of the proteins listed in Table A or is a portion of such a nucleic acid, or a nucleic acid capable of hybridising with such a nucleic acid.
68. Method according to any preceding item, wherein said nucleic acid sequence encodes an orthologue or paralogue of any of the proteins given in Table A.
69. Method according to any preceding item, wherein said enhanced yield-related traits comprise increased yield, preferably increased seed yield relative to control plants.
70. Method according to preceding item, wherein said enhanced yield-related traits are obtained under non-stress conditions.
71. Method according to preceding item, wherein said enhanced yield-related traits are obtained under conditions of drought stress.
72. Method according to any preceding item, wherein said nucleic acid is operably linked to a constitutive promoter, preferably to a GOS2 promoter, most preferably to a GOS2 promoter from rice.
73. Method according to any preceding item, wherein said nucleic acid encoding an ARKL polypeptide is of plant origin, preferably from a monocotyledonous plant, further preferably from the family Poaceae, more preferably from the genus *Oryza*, most preferably from *Oryza sativa*.
74. Plant or part thereof, including seeds, obtainable by a method according to any preceding item, wherein said plant or part thereof comprises a recombinant nucleic acid encoding an ARKL polypeptide.
75. Construct comprising:
    (i) nucleic acid encoding an ARKL polypeptide as defined in items 63 to 65;
    (ii) one or more control sequences capable of driving expression of the nucleic acid sequence of (a); and optionally
    (iii) a transcription termination sequence.
76. Construct according to item 75, wherein one of said control sequences is a constitutive promoter, preferably a GOS2 promoter, most preferably a GOS2 promoter from rice.
77. Use of a construct according to item 75 or 76 in a method for making plants having enhanced yield-related traits preferably increased yield, more preferably increased seed yield relative to control plants.
78. Plant, plant part or plant cell transformed with a construct according to item 75 or 76.
79. Method for the production of a transgenic plant having increased yield, particularly increased seed yield relative to control plants, comprising:
   (i) introducing and expressing in a plant a nucleic acid encoding an ARKL polypeptide as defined in item 63 to 65; and
   (ii) cultivating the plant cell under conditions promoting plant growth and development.
80. Transgenic plant having increased yield, particularly increased seed yield, relative to control plants, resulting from increased expression of a nucleic acid encoding an ARKL polypeptide as defined in item 63 to 65, or a transgenic plant cell derived from said transgenic plant.
81. Transgenic plant according to item 74, 78 or 80, or a transgenic plant cell derived thereof, wherein said plant is a crop plant or a monocot or a cereal, such as rice, maize, wheat, barley, millet, rye, *triticale, sorghum* and oats.
82. Harvestable parts of a plant according to item 81, wherein said harvestable parts are preferably shoot biomass and/or seeds.
83. Products derived from a plant according to item 81 and/or from harvestable parts of a plant according to item 82.
84. Use of a nucleic acid encoding an ARKL polypeptide enhancing yield-related traits preferably increased yield, more preferably increased seed yield relative to control plants.

In one embodiment the invention relates to subject matter summarized as follows:
85. A method for improving yield-related traits in plants relative to control plants, comprising modulating expression in a plant of a nucleic acid encoding a YTP polypeptide comprising
   (i) at least one transmembrane domain and
   (ii) at least a portion of a DUF221 domain
86. Method according to item 85, wherein said portion has in increasing order of preference at least 50%, 55%, 60%, 65%, 70%, 75%, 80%, 85%, 90%, 95%, 96%, 97%, 98%, 99%, or 100% sequence identity any one of the domains represented by SEQ ID NO: 518 to SEQ ID NO: 544.
87. Method according to item 85 or 86, wherein said YTP said nucleic acid encodes a polypeptide having in increasing order of preference at least 50%, 55%, 60%, 65%, 70%, 75%, 80%, 85%, 90%, 95%, 96%, 97%, 98%, 99%, or 100% sequence identity amino acids to any one of the polypeptides of Table A.
88. Method according to any preceding item, wherein said YTP polypeptide further comprises Motif 9 (SEQ ID NO: 545).
89. Method according to any preceding item, wherein said modulated expression is effected by introducing and expressing in a plant a nucleic acid encoding a YTP polypeptide.
90. Method according to any preceding item, wherein said nucleic acid encoding a YTP polypeptide encodes any one of the proteins listed in Table A or is a portion of such a nucleic acid, or a nucleic acid capable of hybridising with such a nucleic acid.
91. Method according to any preceding item, wherein said nucleic acid sequence encodes an orthologue or paralogue of any of the proteins given in Table A or is a portion of such a nucleic acid, or a nucleic acid capable of hybridising with such a nucleic acid.
92. Method according to any preceding item, wherein said enhanced yield-related traits comprise increased yield, preferably increased seed yield relative to control plants.
93. Method according to any one of items 85 to 92, wherein said enhanced yield-related traits are obtained under non-stress conditions.
94. Method according to any one of items 89 to 93, wherein said nucleic acid is operably linked to a constitutive promoter, preferably to a GOS2 promoter, most preferably to a GOS2 promoter from rice.
95. Method according to any preceding item, wherein said nucleic acid encoding a YTP polypeptide is of plant origin, preferably from a dicotyledonous plant, further preferably from the family Poaceae, more preferably from the genus *Oryza*, most preferably from *Oryza sativa*.
96. Plant or part thereof, including seeds, obtainable by a method according to any preceding item, wherein said plant or part thereof comprises a recombinant nucleic acid encoding a YTP polypeptide.
97. Construct comprising:
   (i) nucleic acid encoding a YTP polypeptide as defined in items 85 to 88
   (ii) one or more control sequences capable of driving expression of the nucleic acid sequence of (a); and optionally
   (iii) a transcription termination sequence.
98. Construct according to item 97, wherein one of said control sequences is a constitutive promoter, preferably a GOS2 promoter, most preferably a GOS2 promoter from rice.
99. Use of a construct according to item 97 or 98 in a method for making plants having increased yield, particularly increased seed yield relative to control plants.
100. Plant, plant part or plant cell transformed with a construct according to item 97 or 98.
101. Method for the production of a transgenic plant having increased yield, particularly increased seed yield relative to control plants, comprising:
   (i) introducing and expressing in a plant a nucleic acid encoding a YTP polypeptide as defined in item 85 to 88; and
   (ii) cultivating the plant cell under conditions promoting plant growth and development.
102. Transgenic plant having increased yield, particularly increased seed yield, relative to control plants, resulting from modulated expression of a nucleic acid encoding a YTP polypeptide as defined in item 85 to 88 or a transgenic plant cell derived from said transgenic plant.
103. Transgenic plant according to item 96, 100 or 102, or a transgenic plant cell derived thereof, wherein said plant is a crop plant or a monocot or a cereal, such as rice, maize, wheat, barley, millet, rye, *triticale, sorghum* and oats.
104. Harvestable parts of a plant according to item 103, wherein said harvestable parts are preferably shoot biomass and/or seeds.
105. Products derived from a plant according to item 103 and/or from harvestable parts of a plant according to 104.
106. Use of a nucleic acid encoding a YTP polypeptide in increasing yield, particularly in increasing seed yield and/or shoot biomass in plants, relative to control plants.

DESCRIPTION OF FIGURES

The present invention will now be described with reference to the following figures in which:

FIG. 5 details examples of sequences useful in performing the methods according to the present invention.

FIG. 6 represents the sequence of a rice RAA1-like protein (SEQ ID NO: 121) with the conserved signature sequences indicated in bold underlined.

FIG. 7 shows a multiple alignment of various RAA1-like proteins. NP_001046787 corresponds to Q0E1D7, NP_001052368 corresponds to Q0JEF5, AAR97604 corresponds to Q6RIBO, NP_001042631 corresponds to Q9LGE3, NP_001045304 corresponds to Q8LR63, NP_974763 corresponds to Q9LXB5, NP_197868 corresponds to Q23624, NP_194866 corresponds to Q5Q0B3, NP_001060595 corresponds to Q8H475.

FIG. 10 details examples of sequences useful in performing the methods according to the present invention.

FIG. 11 gives an overview of the conserved motifs present in SEQ ID NO: 169. The leucine rich domain is underlined, the conserved motifs 5, 6 and 7 are indicated in bold and the sequence in italics represents the putative N-glycosylation site with the putative protein kinase C phosphorylation site.

FIG. 12 shows a multiple alignment of various SYR proteins. The asterisks indicate identical amino acid residues, the colons represent highly conserved substitutions and the dots represent less conserved substitutions. With the information from FIG. 11, the various domains and conserved motifs in SEQ ID NO: 171 can be easily identified in the other SYR proteins.

FIG. 14 details examples of sequences useful in performing the methods according to the present invention, or useful in isolating such sequences. Sequences may result from public EST assemblies, with lesser quality sequencing. As a consequence, a few nucleic acid substitutions may be expected. Both 5' and 3' UTRs may also be used for the performing the methods of the invention. SEQ ID NO: 193 represents the ARGOS protein sequence (GenBank accession AY305869).

FIG. 15 represents the amino acid sequence of SEQ ID NO: 213. Conserved domains pfamB2828 and ZfC3H2C3 (pfam00097) are highlighted in bold and underlined characters respectively. The highly conserved Motif 8 is indicated by an underlined dotted line. The most highly conserved amino acid residues in ARKL polypeptides are boxed. The conserved amino metal ligand positions (numbers) and zinc (Zn2+) coordinating amino acid pairs are illustrated.

FIG. 16 represents a multiple alignment of selected ARKL polypeptides. Highly conserved amino acid residues are indicated in the consensus sequence. As shown in the Figure the sequence of the C-terminus of ARKL polypeptides is more highly conserved than the N-terminus.

FIG. 19 details examples of sequences useful in performing the methods according to the present invention.

FIG. 20 represents the sequence of YTP1 (SEQ ID NO: 409). Transmembrane domains are boxed. A part of a DUF221 domain of 124 amino acid residues is highlighted in bold. Motif 8 is underlined. Invariable residues in Motif 8 are indicated with a bigger sized letter type. The first and third loops are predicted to be located on the outside of the membrane; the second loop to the inside.

FIG. 22 represents multiple alignment of selected YTP polypeptides. A consensus sequence as represented by SEQ ID NO: 544 is given. Conserved amino acids residues are indicated in the consensus sequence; blanks represent regions of low conservation.

FIG. 24 details examples of sequences useful in performing the methods according to the present invention.

EXAMPLES

Figure 1:
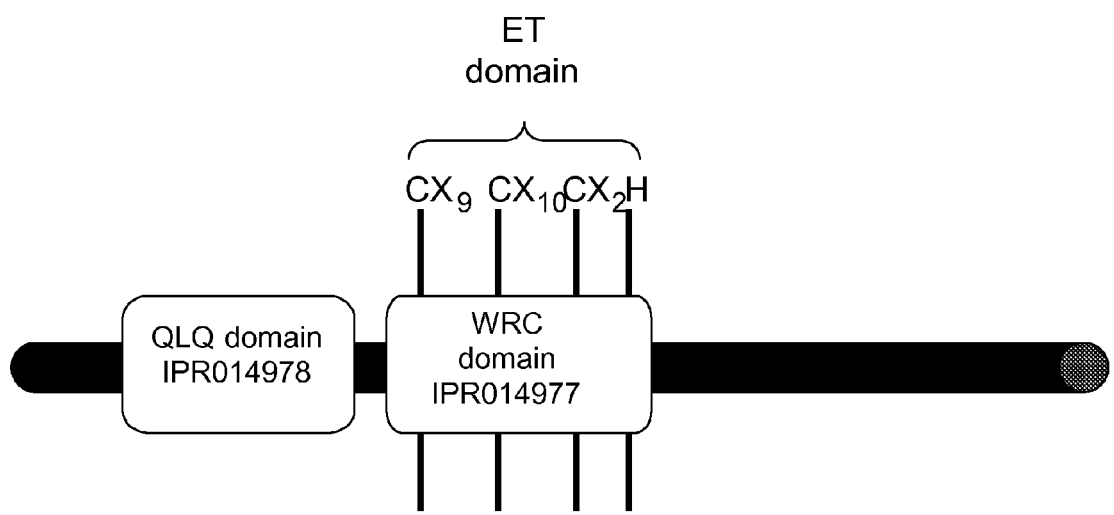
FIG. 1 represents a cartoon of a GRF polypeptide as represented by SEQ ID NO: 2, which comprises the following features: (i) a QLQ domain with an InterPro accession IPR014978 (PFAM accession PF08880); (ii) a WRC domain with an InterPro accession IPR014977 (PFAM accession PF08879); and (iii) an Effector of Transcription (ET) domain comprising three Cys and one His residues in a conserved spacing ($CX_9CX_{10}CX_2H$), located in the WRC domain.

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of Sequences Related to the Nucleic Acid Sequence Used in the Methods of the Invention Sequences (full length cDNA, ESTs or genomic) related to the nucleic acid sequence used in the methods of the present invention were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid sequence or polypeptide sequences to sequence databases and by calculating the statistical significance of matches. For example, the polypeptide encoded by the nucleic acid sequence of the present invention was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid sequence (or polypeptide) sequences over a particular length. In some instances, the default parameters may be adjusted to modify the stringency of the search. For example the E-value may be increased to show less stringent matches. This way, short nearly exact matches may be identified.

Table A provides a list of nucleic acid sequences related to the nucleic acid sequence used in the methods of the present invention.

TABLE A1

Examples of GRF polypeptide sequences, and encoding nucleic acid sequences:

| Name | Source organism | Nucleic acid SEQ ID NO: | Polypeptide SEQ ID NO: | Database accession number |
|---|---|---|---|---|
| Arath_GRF_At3G13960.1 | *Arabidopsis thaliana* | 1 | 2 | AT3G13960.1 |
| Arath_GRF_At2G06200.1 | *Arabidopsis thaliana* | 3 | 4 | At2G06200.1 |
| Arath_GRF_At2G22840.1 | *Arabidopsis thaliana* | 5 | 6 | At2G22840.1 |
| Arath_GRF_At2G36400.1 | *Arabidopsis thaliana* | 7 | 8 | At2G36400.1 |
| Arath_GRF_At2G45480.1 | *Arabidopsis thaliana* | 9 | 10 | At2G45480.1 |
| Arath_GRF_At3G52910.1 | *Arabidopsis thaliana* | 11 | 12 | At3G52910.1 |
| Arath_GRF_At4G24150.1 | *Arabidopsis thaliana* | 13 | 14 | At4G24150.1 |
| Arath_GRF_At4G37740.1 | *Arabidopsis thaliana* | 15 | 16 | At4G37740.1 |
| Arath_GRF_At5G53660.1 | *Arabidopsis thaliana* | 17 | 18 | At5G53660.1 |
| Aqufo_GRF | *Aquilegia formosa* x *Aquilegia pubescens* | 19 | 20 | DT756681.1 DR946716.1 |
| Brana_GRF | *Brassica napus* | 21 | 22 | CN730217.1 ES922527 |
| Horvu_GRF | *Hordeum vulgare* | 23 | 24 | AK250947.1 |
| Lyces_GRF | *Lycopersicon esculentum* | 25 | 26 | BT013977.1 |
| Medtr_GRF | *Medicago truncatula* | 27 | 28 | AC144645.17 |
| Medtr_GRF like | *Medicago truncatula* | 29 | 30 | AC174350.4 |
| Orysa_GRF_Os02g47280.2 | *Oryza sativa* | 31 | 32 | Os02g47280.2 |
| Orysa_GRF_Os02g53690.1 | *Oryza sativa* | 33 | 34 | Os02g53690.1 |
| Orysa_GRF_Os03g51970.1 | *Oryza sativa* | 35 | 36 | Os03g51970.1 |
| Orysa_GRF_Os04g48510.1 | *Oryza sativa* | 37 | 38 | Os04g48510.1 |
| Orysa_GRF_Os04g51190.1 | *Oryza sativa* | 39 | 40 | Os04g51190.1 |
| Orysa_GRF_Os06g02560.1 | *Oryza sativa* | 41 | 42 | Os06g02560.1 |
| Orysa_GRF_Os11g35030.1 | *Oryza sativa* | 43 | 44 | Os11g35030.1 |
| Orysa_GRF_Os12g29980.1 | *Oryza sativa* | 45 | 46 | Os12g29980.1 |
| Oyrsa_GRF_Os03g47140.1 | *Oryza sativa* | 47 | 48 | Os03g47140.1 |
| Orysa_GRF_gi_115447910_ref_NM_001054270.1 | *Oryza sativa* | 49 | 50 | NM_001054270.1 |
| Orysa_GRF_gi_115460325_ref_NM_001060298.1 | *Oryza sativa* | 51 | 52 | NM_001060298.1 |
| Orysa_GRF_gi_115471984_ref_NM_001066126.1 | *Oryza sativa* | 53 | 54 | NM_001066126.1 |

TABLE A1-continued

Examples of GRF polypeptide sequences, and encoding nucleic acid sequences:

| Name | Source organism | Nucleic acid SEQ ID NO: | Polypeptide SEQ ID NO: | Database accession number |
|---|---|---|---|---|
| Poptr_GRF_lcl_scaff_XIV.39 | Populus tremuloides | 55 | 56 | lcl_scaff_XIV.39 |
| Poptr_GRF_lcl_scaff_II.1070 | Populus tremuloides | 57 | 58 | lcl_scaff_II.1070 |
| Poptr_GRF_lcl_scaff_I.1018 | Populus tremuloides | 59 | 60 | lcl_scaff_I.1018 |
| Poptr_GRF_lcl_scaff_28.10 | Populus tremuloides | 61 | 62 | lcl_scaff_28.10 |
| Poptr_GRF_lcl_scaff_I.995 | Populus tremuloides | 63 | 64 | lcl_scaff_I.995 |
| Poptr_GRF_lcl_scaff_III.741 | Populus tremuloides | 65 | 66 | lcl_scaff_III.741 |
| Poptr_GRF_lcl_scaff_VII.1274 | Populus tremuloides | 67 | 68 | lcl_scaff_VII.1274 |
| Poptr_GRF_lcl_scaff_XII.277 | Populus tremuloides | 69 | 70 | lcl_scaff_XII.277 |
| Poptr_GRF_lcl_scaff_XIII.769 | Populus tremuloides | 71 | 72 | lcl_scaff_XIII.769 |
| Poptr_GRF_lcl_scaff_XIV.174 | Populus tremuloides | 73 | 74 | lcl_scaff_XIV.174 |
| Poptr_GRF_lcl_scaff_XIV.51 | Populus tremuloides | 75 | 76 | lcl_scaff_XIV.51 |
| Poptr_GRF_lcl_scaff_XIX.480 | Populus tremuloides | 77 | 78 | lcl_scaff_XIX.480 |
| Poptr_GRF_lcl_scaff_28.309 | Populus tremuloides | 79 | 80 | lcl_scaff_28.309 |
| Poptr_GRF_lcl_scaff_I.688 | Populus tremuloides | 81 | 82 | lcl_scaff_I.688 |
| Sacof_GRF | Saccharum officinarum | 83 | 84 | CA084837.1 CA238919.1 CA122516.1 |
| Vitvi_GRF | Vitis vinifera | 85 | 86 | AM468035 |
| Zeama_GRF10_gi_146008494_gb_EF515849.1 | Zea mays | 87 | 88 | EF515849.1 |
| Zeama_GRF11_gi_146008515_gb_EF515850.1 | Zea mays | 89 | 90 | EF515850.1 |
| Zeama_GRF12_gi_146008534_gb_EF515851.1 | Zea mays | 91 | 92 | EF515851.1 |
| Zeama_GRF13_gi_146008539_gb_EF515852.1 | Zea mays | 93 | 94 | EF515852.1 |
| Zeama_GRF14_gi_146008560_gb_EF515853.1 | Zea mays | 95 | 96 | EF515853.1 |
| Zeama_GRF1_gi_146008330_gb_EF515840.1 | Zea mays | 97 | 98 | EF515840.1 |
| Zeama_GRF2_gi_146008352_gb_EF515841.1 | Zea mays | 99 | 100 | EF515841.1 |
| Zeama_GRF3_gi_146008368_gb_EF515842.1 | Zea mays | 101 | 102 | EF515842.1 |
| Zeama_GRF4_gi_146008393_gb_EF515843.1 | Zea mays | 103 | 104 | EF515843.1 |
| Zeama_GRF5_gi_146008412_gb_EF515844.1 | Zea mays | 105 | 106 | EF515844.1 |
| Zeama_GRF6_gi_146008429_gb_EF515845.1 | Zea mays | 107 | 108 | EF515845.1 |
| Zeama_GRF7_gi_146008440_gb_EF515846.1 | Zea mays | 109 | 110 | EF515846.1 |
| Zeama_GRF8_gi_146008461_gb_EF515847.1 | Zea mays | 111 | 112 | EF515847.1 |
| Zeama_GRF9_gi_146008475_gb_EF515848.1 | Zea mays | 113 | 114 | EF515848.1 |

TABLE A2

Examples of RAA1-like polypeptides:

| Plant Source | Nucleic acid SEQ ID NO: | Protein SEQ ID NO: |
|---|---|---|
| Q9LGE3 | SEQ ID NO: 120 | SEQ ID NO: 121 |
| Q8H475 | SEQ ID NO: 126 | SEQ ID NO: 127 |
| A3BNA1 | SEQ ID NO: 128 | SEQ ID NO: 129 |
| O23624 | SEQ ID NO: 130 | SEQ ID NO: 131 |
| Q8LR63 | SEQ ID NO: 132 | SEQ ID NO: 133 |
| Q9LXB5 | SEQ ID NO: 134 | SEQ ID NO: 135 |
| Q5Q0B3 | SEQ ID NO: 136 | SEQ ID NO: 137 |
| Q7XX25 | SEQ ID NO: 138 | SEQ ID NO: 139 |
| A2WN18 | SEQ ID NO: 140 | SEQ ID NO: 141 |
| O24340 | SEQ ID NO: 142 | SEQ ID NO: 143 |
| A2X4J6 | SEQ ID NO: 144 | SEQ ID NO: 145 |
| Q0E1D7 | SEQ ID NO: 146 | SEQ ID NO: 147 |
| O49587 | SEQ ID NO: 148 | SEQ ID NO: 149 |
| A2XRE0 | SEQ ID NO: 150 | SEQ ID NO: 151 |
| Q6RIB0 | SEQ ID NO: 152 | SEQ ID NO: 153 |
| Q9LXB6 | SEQ ID NO: 154 | SEQ ID NO: 155 |
| Q0JEF5 | SEQ ID NO: 156 | SEQ ID NO: 157 |
| NP1050091 | SEQ ID NO: 158 | SEQ ID NO: 159 |
| A5BZJ2 | SEQ ID NO: 160 | SEQ ID NO: 161 |

In addition to the publicly available nucleic acid sequences available at NCBI, proprietary sequence databases are also searched following the same procedure as described herein above.

Table A3 provides a list of nucleic acid and protein sequences related to the nucleic acid sequence as represented by SEQ ID NO: 168 and the protein sequence represented by SEQ ID NO: 169.

TABLE A3

Nucleic acid sequences related to the nucleic acid sequence (SEQ ID NO: 168) useful in the methods of the present invention, and the corresponding deduced polypeptides.

| Name | Source organism | Poly-peptide SEQ ID NO: | Nucleic acid SEQ ID NO: | Database accession number | Status |
|---|---|---|---|---|---|
| OsSYR | Oryza sativa | 169 | 168 | / | Full length or partial |
| rice SYR homologue 1 | Oryza sativa | 179 | 194 | XP_472637 | Full length |
| rice SYR homologue 2 | Oryza sativa | 180 | | AP008218 | Full length |
| corn SYR homologue | Zea mays | 181 | 195 | AY110705 | partial |
| wheat SYR homologue | Triticum aestivum | 182 | | / | Full length |
| barley SYR homologue | Hordeum vulgare | 183 | 203 | CB871444 | Full length |
| sugar cane SYR homologue 1 | Saccharum officinarum | 184 | 204 | CA165713 | partial |
| sugar cane SYR homologue 2 | Saccharum officinarum | 185 | 205 | CA242805 | Full length |
| sorghum SYR homologue | Sorghum bicolor | 186 | 206 | CX611532 | Full length |
| AtSYR homologue 1 | Arabidopsis thaliana | 187 | 207 | NM_115853 | Full length |
| AtSYR homologue 2 | Arabidopsis thaliana | 188 | 208 | NM_180078 | Full length |
| grape SYR homologue | Vitis vinifera | 189 | 196 | CF404276 | Full length |
| Citrus SYR homologue | Citrus reticulata | 190 | 197 | CF830612 | partial |
| tomato SYR homologue 1 | Lycopersicon esculentum | 191 | 199 | AI774560 | Full length |
| tomato SYR homologue 2 | Lycopersicon esculentum | 192 | 198 | BG125370 | Full length |
| Argos | Arabidopsis thaliana | 193 | 209 | AY305869 | Full length |

TABLE A4

Examples of ARKL nucleic acids and the respectively encoded polypeptides.

| Description* | Plant Source | Nucleic acid SEQ ID NO: | Protein SEQ ID NO: |
|---|---|---|---|
| Orysa_ARKL1 | Oryza sativa | 212 | 213 |
| Orysa_ARKL2 | Oryza sativa | 214 | 215 |
| Orysa_ARKL3 | Oryza sativa | 216 | 217 |
| Orysa_ARKL4 | Oryza sativa | 218 | 219 |
| Orysa_ARKL5 | Oryza sativa | 220 | 221 |
| Orysa_ARKL6 | Oryza sativa | 222 | 223 |
| Orysa_ARKL7 | Oryza sativa | 224 | 225 |
| Orysa_ARKL8 | Oryza sativa | 226 | 227 |
| Orysa_ARKL9 | Oryza sativa | 228 | 229 |
| Zeama_ARKL1 | Zea mays | 230 | 231 |
| Zeama_ARKL2 | Zea mays | 232 | 233 |
| Horvu_ARKL1 | Hordeum vulgare | 234 | 235 |
| Horvu_ARKL2 | Hordeum vulgare | 236 | 237 |
| Horvu_ARKL3 | Hordeum vulgare | 238 | 239 |
| Lyces_ARKL1 | Lycopersicum esculentum | 240 | 241 |
| Lyces_ARKL2 | Lycopersicum esculentum | 242 | 243 |
| Lyces_ARKL3 | Lycopersicum esculentum | 244 | 245 |
| Glyma_ARKL1 | Glycine max | 246 | 247 |
| Glyma_ARKL2 | Glycine max | 248 | 249 |
| Zinel_ARKL1 | Zinnia elegans | 250 | 251 |
| Lotja_ARKL1 | Lotus japonicus | 252 | 253 |
| Arath_ARKL1 | Arabidopsis thaliana | 254 | 255 |
| Arath_ARKL2 | Arabidopsis thaliana | 256 | 257 |
| Arath_ARKL3 | Arabidopsis thaliana | 258 | 259 |
| Arath_ARKL4 | Arabidopsis thaliana | 260 | 261 |
| Arath_ARKL5 | Arabidopsis thaliana | 262 | 263 |
| Arath_ARKL6 | Arabidopsis thaliana | 264 | 265 |
| Arath_ARKL7 | Arabidopsis thaliana | 266 | 267 |
| Arath_ARKL8 | Arabidopsis thaliana | 268 | 269 |
| Arath_ARKL9 | Arabidopsis thaliana | 270 | 271 |
| Arath_ARKL10 | Arabidopsis thaliana | 272 | 273 |
| Arath_ARKL11 | Arabidopsis thaliana | 274 | 275 |
| Arath_ARKL12 | Arabidopsis thaliana | 276 | 277 |
| Poptr_ARKL1 | Populus trichocarpa | 278 | 279 |
| Poptr_ARKL2 | Populus trichocarpa | 280 | 281 |
| Poptr_ARKL3 | Populus trichocarpa | 282 | 283 |
| Poptr_ARKL4 | Populus trichocarpa | 284 | 285 |
| Poptr_ARKL5 | Populus trichocarpa | 286 | 287 |
| Poptr_ARKL6 | Populus trichocarpa | 288 | 289 |
| Poptr_ARKL7 | Populus trichocarpa | 290 | 291 |
| Poptr_ARKL8 | Populus trichocarpa | 292 | 293 |
| Poptr_ARKL9 | Populus trichocarpa | 294 | 295 |
| Poptr_ARKL10 | Populus trichocarpa | 296 | 297 |
| Medtr_ARKL1 | Medicago truncatula | 298 | 299 |
| Medtr_ARKL2 | Medicago truncatula | 300 | 301 |
| Medtr_ARKL3 | Medicago truncatula | 302 | 303 |
| Medtr_ARKL4 | Medicago truncatula | 304 | 305 |

*Orysa: Oryza sativa; Zeama: Zea mays; Horvu: Hordeum vulgare; Lyces: Lycopersicum esculentum; Glyma: Glycine max; Zinel: Zinnia elegans; Lotja: Lotus japonicus; Arath: Arabidopsis thaliana; Poptr: Populus thricocarpa; Medtr: Medicago truncatula.

Table A5 provides a list of nucleic acid sequences related to the nucleic acid sequence used in the methods of the present invention.

TABLE A5

Examples of YTP nucleic acids and polypeptides:

| Name | Name Alias | Source Organism | Nucleic Acid SEQ ID NO | Protein SEQ ID NO |
|---|---|---|---|---|
| YTP1 | YTP1_PARTIAL | *Oryza sativa* | 408 | 409 |
| YTP2 | Os01g0534900 (768) | *Oryza sativa* | 410 | 411 |
| YTP3 | Os01g0950900 (701) | *Oryza sativa* | 412 | 413 |
| YTP4 | Os03g0137400 (792) | *Oryza sativa* | 414 | 415 |
| YTP5 | Os03g0673800 (777) | *Oryza sativa* | 416 | 417 |
| YTP6 | Os03g0726300 (743) | *Oryza sativa* | 418 | 419 |
| YTP7 | Os05g0393800 (767) | *Oryza sativa* | 420 | 421 |
| YTP8 | Os05g0594700 (766) | *Oryza sativa* | 422 | 423 |
| YTP9 | Os07g0150100 (731) | *Oryza sativa* | 424 | 425 |
| YTP10 | Os10g0579100 (810) | *Oryza sativa* | 426 | 427 |
| YTP11 | Os12g0582800 (695) | *Oryza sativa* | 428 | 429 |
| YTP12 | Os12g0633600 (763) | *Oryza sativa* | 430 | 431 |
| YTP13 | AT1G10090 (762) | *Arabidopsis thaliana* | 432 | 433 |
| YTP14 | AT1G11960 (375) | *Arabidopsis thaliana* | 434 | 435 |
| YTP15 | AT1G30360 (724) | *Arabidopsis thaliana* | 436 | 437 |
| YTP16 | AT1G58520 (657) | *Arabidopsis thaliana* | 438 | 439 |
| YTP17 | AT1G62320 (769) | *Arabidopsis thaliana* | 440 | 441 |
| YTP18 | AT1G69450 (711) | *Arabidopsis thaliana* | 442 | 443 |
| YTP19 | AT3G01100 (596) | *Arabidopsis thaliana* | 444 | 445 |
| YTP20 | AT3G21620 (756) | *Arabidopsis thaliana* | 446 | 447 |
| YTP21 | AT3G54510 (617) | *Arabidopsis thaliana* | 448 | 449 |
| YTP22 | AT4G02900 (806) | *Arabidopsis thaliana* | 450 | 451 |
| YTP23 | AT4G04340 (772) | *Arabidopsis thaliana* | 452 | 453 |
| YTP24 | AT4G15430 (761) | *Arabidopsis thaliana* | 454 | 455 |
| YTP25 | AT4G22120 (771) | *Arabidopsis thaliana* | 456 | 457 |
| YTP26 | AT4G35870 (817) | *Arabidopsis thaliana* | 458 | 459 |
| YTP27 | AQGI.2hit1partialAquilegia (PGI) (707) | *Aquilegia* species | 460 | 461 |
| YTP28 | lcl_175_Medicago (712) | *Medicago truncatula* | 462 | 463 |
| YTP29 | lcl_21269_Medicago (790) | *Medicago truncatula* | 464 | 465 |
| YTP30 | lcl_24278_Medicago (766) | *Medicago truncatula* | 466 | 467 |
| YTP31 | lcl_3723_Medicago (461) | *Medicago truncatula* | 468 | 469 |
| YTP32 | lcl_scaff_1405.2 (301) | *Populus trichocarpa* | 470 | 471 |
| YTP33 | lcl_scaff_1405.3 (276) | *Populus trichocarpa* | 472 | 473 |
| YTP34 | lcl_scaff_166.26 (775) | *Populus trichocarpa* | 474 | 475 |
| YTP35 | lcl_scaff_166.27 (774) | *Populus trichocarpa* | 476 | 477 |
| YTP36 | lcl_scaff_29.271 (831) | *Populus trichocarpa* | 478 | 479 |
| YTP37 | lcl_scaff_I.2570 (724) | *Populus trichocarpa* | 480 | 481 |
| YTP38 | lcl_scaff_II.1056 (706) | *Populus trichocarpa* | 482 | 483 |
| YTP39 | lcl_scaff_II.2075 (767) | *Populus trichocarpa* | 484 | 485 |
| YTP40 | lcl_scaff_III.1644 (726) | *Populus trichocarpa* | 486 | 487 |
| YTP41 | lcl_scaff_III.729 (516) | *Populus trichocarpa* | 488 | 489 |
| YTP42 | lcl_scaff_IV.1089 (436) | *Populus trichocarpa* | 490 | 491 |
| YTP43 | lcl_scaff_VIII.848 (714) | *Populus trichocarpa* | 492 | 493 |
| YTP44 | lcl_scaff_XI.92 (546) | *Populus trichocarpa* | 494 | 495 |
| YTP45 | lcl_scaff_XI.94 (708) | *Populus trichocarpa* | 496 | 497 |
| YTP46 | lcl_scaff_XIV.1036 (846) | *Populus trichocarpa* | 498 | 499 |
| YTP47 | Triae_TA80116_4565 (535) | *Triticum aestivum* | 500 | 501 |
| YTP48 | volvox2_104236 | *Volvox carteri* | 502 | 503 |
| YTP49 | VOLVOX_95919 | *Volvox carteri* | 504 | 505 |
| YTP50 | chlamy-174910 (1129) | *Chlamydomonas reinhardtii* | 506 | 507 |
| YTP51 | chlamy-194774 (1429) | *Chlamydomonas reinhardtii* | 508 | 509 |
| YTP52 | ref_NP_014557.1_(991) | *Schizosaccharomyces pombe* | 510 | 511 |
| YTP53 | ref_NP_592939.1_(871) | *Ashbya gossypii* | 512 | 513 |
| YTP54 | ref_NP_984890.1_(875) | *Kluyveromyces lactis* | 514 | 515 |
| YTP55 | ref_XP_452699.1_(967) | *Saccharomyces cerevisiae* | 516 | 517 |

In some instances, related sequences have tentatively been assembled and publicly disclosed by research institutions, such as The Institute for Genomic Research (TIGR). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute, for example for poplar and *Ostreococcus tauri*.

Example 2 a) Alignment of GRF Polypeptide Sequences

Figure 2:
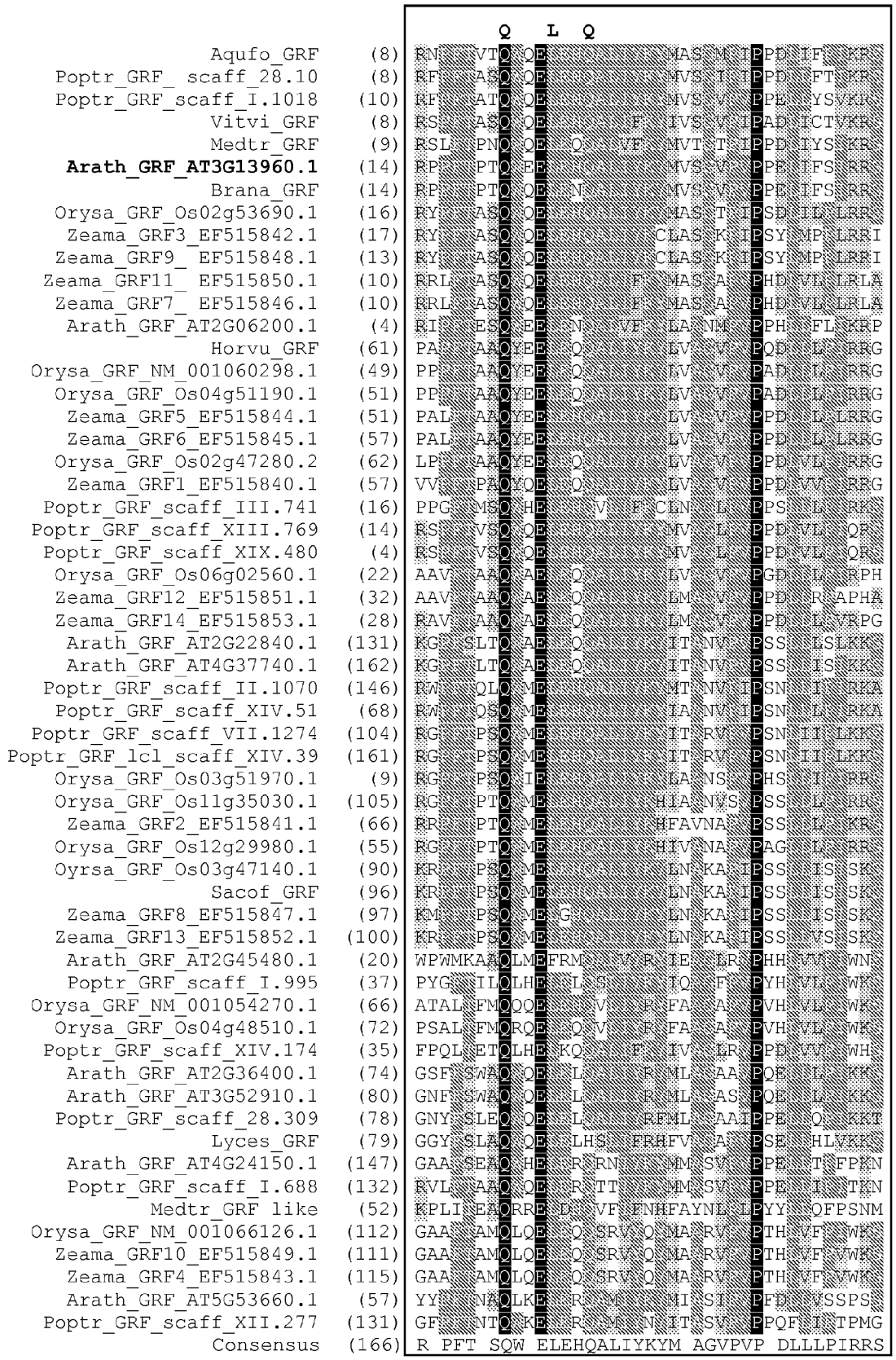
FIG. 2 shows an AlignX (from Vector NTI 10.3, Invitrogen Corporation) multiple sequence alignment of the QLQ domain of GRF polypeptides from Table A (as represented by SEQ ID NO: 115 for SEQ ID NO: 2). The conserved QLQ amino acid residues are located on the top of the multiple alignment. Two other very conserved residues (boxed in black) are E (Glu) and P (Pro).
Figures 3, 23:
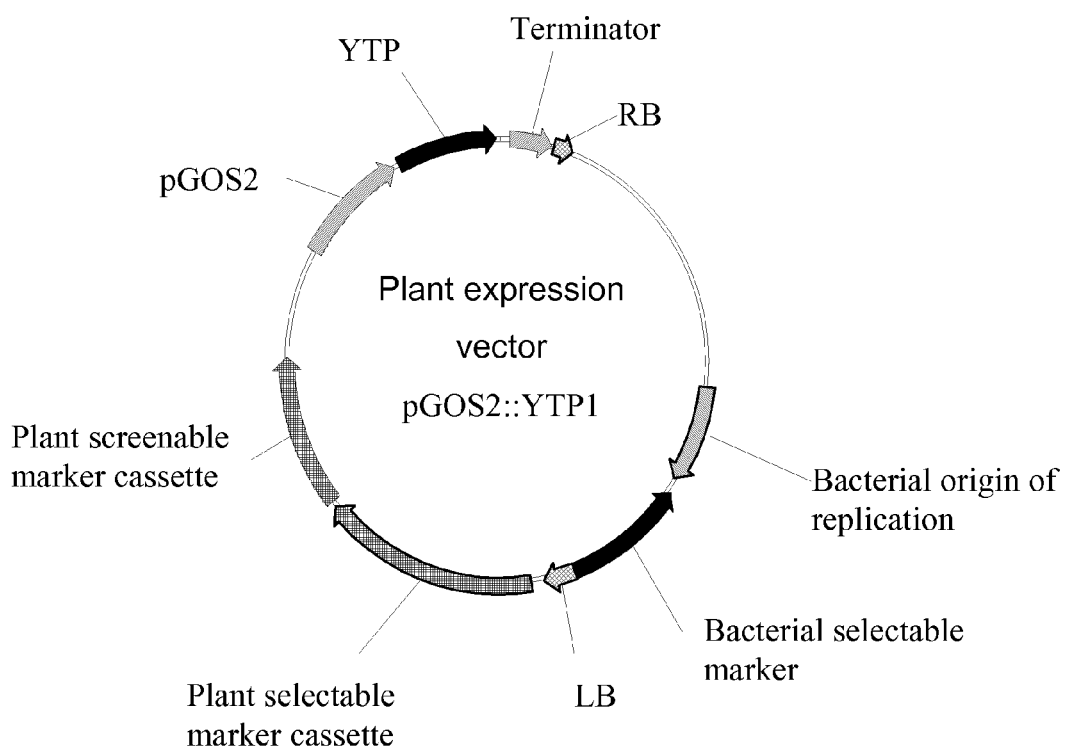
FIG. 3 shows an AlignX (from Vector NTI 10.3, Invitrogen Corporation) multiple sequence alignment of the WRC domain of GRF polypeptides from Table A (as represented by SEQ ID NO: 116 for SEQ ID NO: 2). The conserved WRC amino acid residues are in bold in the consensus sequence. The three Cys and one His residues in a conserved spacing ($CX_9CX_{10}CX_2H$), designated as the Effector of Transcription (ET) domain, are boxed vertically across the alignment, and also identified at the bottom of the alignment. The putative nuclear localisation signal (NLS) comprised in the WRC domain, is double-underlined.
FIG. 23 represents the binary vector for increased expression in *Oryza sativa* of a YTP1-encoding nucleic acid under the control of a rice GOS2 promoter (pGOS2).

Mutliple sequence alignment of all the GRF polypeptide sequences in Table A was performed using the AlignX algorithm (from Vector NTI 10.3, Invitrogen Corporation). Results of the alignment for the QLQ domain of GRF polypeptides from Table A (as represented by SEQ ID NO: 115 for SEQ ID NO: 2) are shown in FIG. 2 of the present application. The conserved QLQ amino acid residues are located on the top of the multiple alignment. Two other very conserved residues (boxed in black) are E (Glu) and P (Pro). Results of the alignment for the WRC domain of the GRF polypeptides from Table A (as represented by SEQ ID NO: 116 for SEQ ID NO: 2) are shown in FIG. 3 of the present application. The conserved WRC amino acid residues are in bold in the consensus sequence. The three Cys and one His residues in a conserved spacing ($CX_9CX_{10}CX_2H$), designated as the Effector of Transcription (ET) domain, are b) Alignment of RAA1-like Polypeptide Sequences Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values are for the gap open penalty of 10, for the gap extension penalty of 0.1 and the selected weight matrix is Blosum 62 (if polypeptides are aligned). Minor manual editing was done to further optimise the alignment. Sequence conservation among RAA1-like polypeptides is essentially throughout the whole sequence with the exception of a Gly and/or Ser rich region in the N-terminal half of the protein. The RAA1-like polypeptides are aligned in FIG. 7.

c) Alignment of SYR_Polypeptide Sequences

AlignX (Vector NTI, Invitrogen) is based on the popular Clustal algorithm of progressive alignment (Thompson et al. (1997) Nucleic Acids Res 25:4876-4882; Chenna et al. (2003). Nucleic Acids Res 31:3497-3500). A phylogenetic tree can be constructed using a neighbour-joining clustering algorithm. Default values are for the gap open penalty of 10, for the gap extension penalty of 0.1 and the selected weight matrix is Blosum 62 (if polypeptides are aligned).

The result of the multiple sequence alignment using polypeptides relevant in identifying the ones useful in performing the methods of the invention is shown in FIG. 12. The leucine rich repeat and the conserved motifs can be easily discriminated in the various sequences.

d) Alignment of ARKL Polypeptide Sequences

Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values are for the gap open penalty of 10, for the gap extension penalty of 0.1 and the selected weight matrix is Blosum 62 (if polypeptides are aligned). Minor manual editing may be done to further optimise the alignment. Sequence conservation among ARKL polypeptides is essentially in the C-terminal along the DAR1 and RING-H2 domain of the polypeptides, the N-terminal domain usually being more variable in sequence length and composition. The ARKL polypeptides are aligned in FIG. 16.

Figure 17:
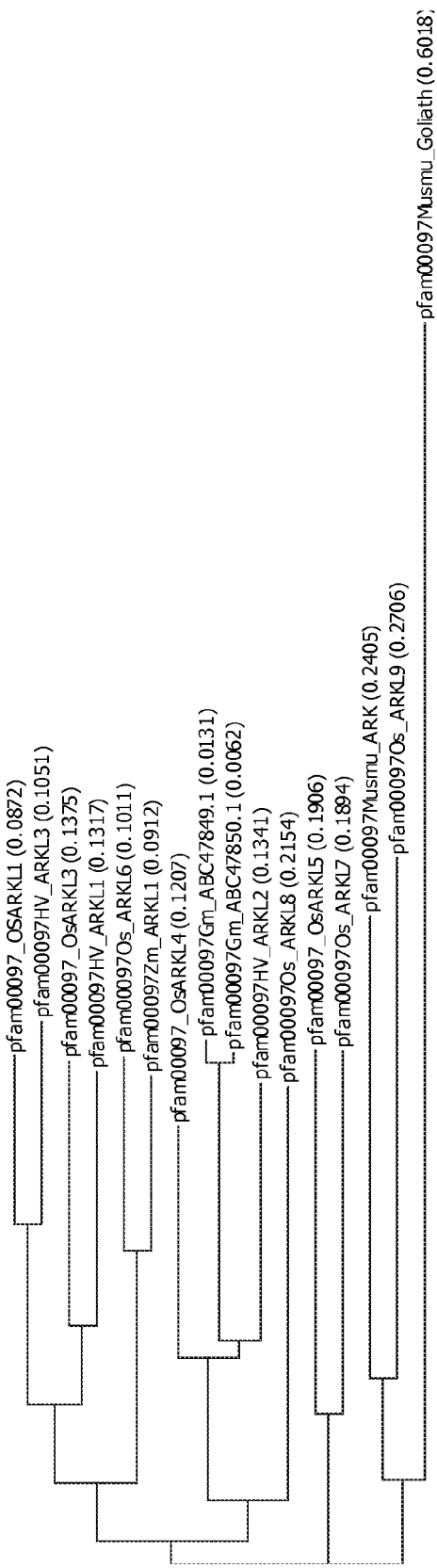
FIG. 17 shows a phylogenetic tree of ARKL polypeptides based on an alignment of the RING finger (pfam00097) domain comprised in ARKL polypeptides as represented by SEQ ID NO: 306-314, 316-318, 322, 323, 402 (SEQ ID NO: 402 comprises the pfam00097 (RING zinc finger) domain present in the Akadia polypeptide of *Mus musculus* and SEQ ID NO: 403 represents the pfam00097 domain as present in the Goliath polypeptide of *Mus musculus*. Abbreviations used: Os: *Oryza sativa* (Orysa); Hv: *Hordeum vulgare* (Horvu); Gm: *Glycine max* (Glyma); Zm: *Zea mays* (Zeama); Musmu: *Mus musculus*.

A phylogenetic tree of ARKL polypeptides (FIG. 17) was constructed using a neighbour-joining clustering algorithm as provided in the AlignX programme from the Vector NTI (Invitrogen).

e) Alignment of YTP Polypeptide Sequences

Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values are for the gap open penalty of 10, for the gap extension penalty of 0.1 and the selected weight matrix is Blosum 62 (if polypeptides are aligned). Minor manual editing may be done to further optimise the alignment. Sequence conservation among YTP polypeptides is higher in the C-terminus of the protein of the polypeptides along the DUF221 domain. The N-terminal domain is usually more variable in sequence length and composition. The YTP polypeptides are aligned in FIG. 22. Highly conserved amino acid residues are indicated in the consensus sequence (see FIG. 22).

Figure 21:
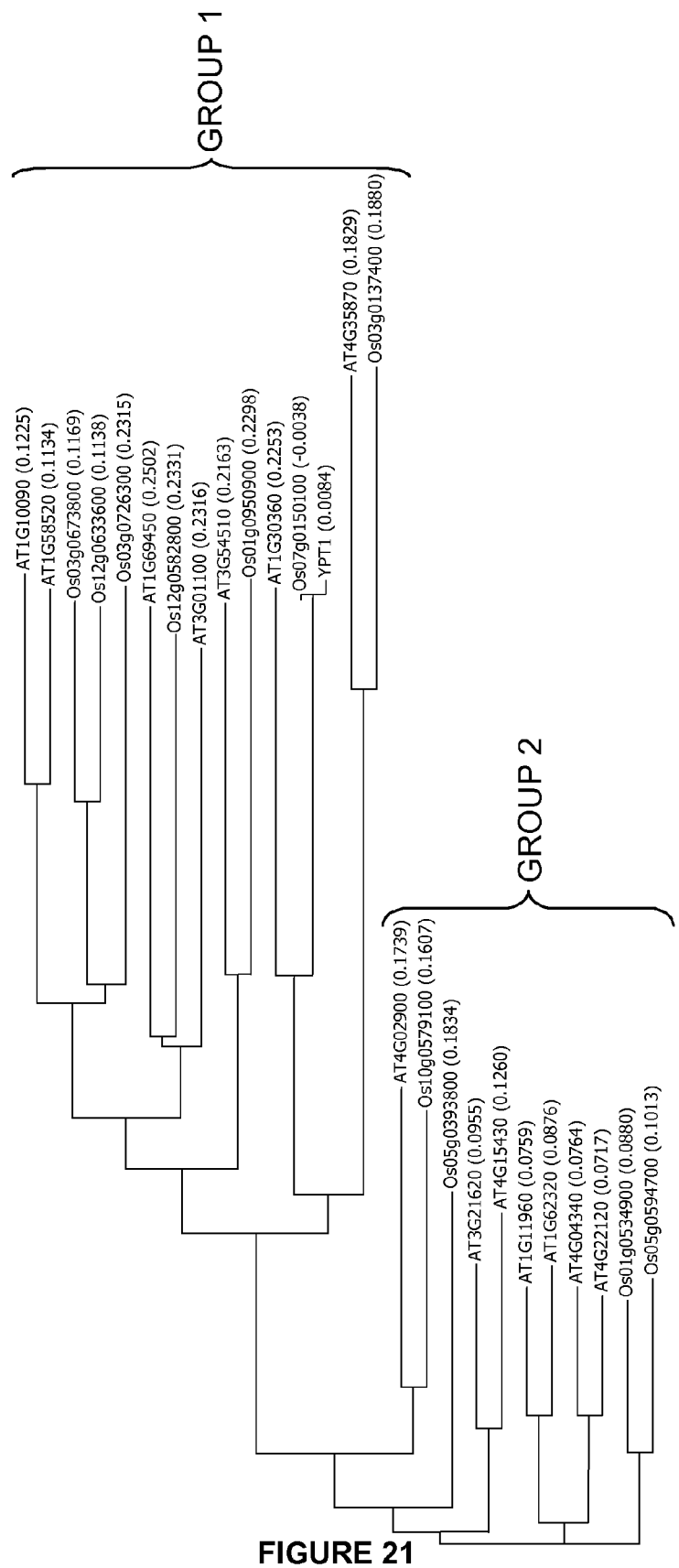
FIG. 21 shows phylogenetic tree of a selection of YTP polypeptides.

A phylogenetic tree of YTP polypeptides (FIG. 21) was constructed using a neighbour-joining clustering algorithm as provided in the AlignX programme from the Vector NTI (Invitrogen). As shown in FIG. 21, Group 1 comprises the YTP polypeptides clustering with SEQ ID NO: 409 (YTP1 in FIG. 21).

Example 3

Calculation of Global Percentage Identity Between Polypeptide Sequences Useful in Performing the Methods of the Invention Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2
Results of the software analysis are shown in Table B for the global similarity and identity over the full length of the polypeptide sequences (excluding the partial polypeptide sequences).

TABLE B1

MatGAT results for global similarity and identity over the full length of the polypeptide sequences related to GRF.

| | 1 | 2 | 3 | 4 | 5 | 6 | 7 | 8 | 9 | 10 | 11 | 12 | 13 | 14 |
|---|---|---|---|---|---|---|---|---|---|---|---|---|---|---|
| 1. Aqufo_GRF | | 31 | 22 | 25 | 23 | 38 | 22 | 19 | 22 | 23 | 39 | 31 | 21 | 46 |
| 2. Arath_GRF_ AT2G06200.1 | 43 | | 18 | 23 | 20 | 28 | 18 | 17 | 18 | 21 | 27 | 26 | 21 | 32 |
| 3. Arath_GRF_ | 36 | 25 | | 26 | 19 | 22 | 22 | 23 | 57 | 21 | 21 | 24 | 27 | 22 |

TABLE B1-continued

MatGAT results for global similarity and identity over the full length of the polypeptide sequences related to GRF.

| | | 1 | 2 | 3 | 4 | 5 | 6 | 7 | 8 | 9 | 10 | 11 | 12 | 13 | 14 |
|---|---|---|---|---|---|---|---|---|---|---|---|---|---|---|---|
| 4. Arath_GRF_ | AT2G22840.1 | 43 | 31 | 38 | ■ | 23 | 27 | 48 | 23 | 26 | 26 | 24 | 26 | 47 | 25 |
| 5. Arath_GRF_ | AT2G36400.1 | 38 | 30 | 33 | 39 | ■ | 21 | 21 | 16 | 17 | 23 | 22 | 23 | 21 | 24 |
| 6. Arath_GRF_ | AT2G45480.1 | 53 | 38 | 34 | 44 | 34 | ■ | 23 | 18 | 21 | 22 | 83 | 29 | 22 | 45 |
| 7. Arath_GRF_ | AT3G13960.1 | 34 | 26 | 40 | 56 | 36 | 36 | ■ | 20 | 24 | 22 | 23 | 22 | 31 | 22 |
| 8. Arath_GRF_ | AT3G52910.1 | 31 | 25 | 38 | 36 | 32 | 30 | 35 | ■ | 23 | 25 | 19 | 21 | 25 | 18 |
| 9. Arath_GRF_ | AT4G24150.1 | 35 | 24 | 72 | 38 | 33 | 31 | 40 | 39 | ■ | 21 | 23 | 23 | 26 | 23 |
| 10. Arath_GRF_ | AT4G37740.1 | 37 | 30 | 35 | 40 | 35 | 37 | 34 | 36 | 33 | ■ | 24 | 27 | 25 | 23 |
| 11. Brana_GRF | AT5G53660.1 | 54 | 39 | 33 | 41 | 35 | 90 | 33 | 33 | 34 | 39 | ■ | 28 | 21 | 47 |
| 12. Horvu_GRF | | 49 | 34 | 35 | 42 | 39 | 44 | 35 | 32 | 35 | 41 | 47 | ■ | 25 | 25 |
| 13. Lyces_GRF | | 42 | 30 | 38 | 64 | 37 | 41 | 43 | 38 | 36 | 41 | 40 | 42 | ■ | 24 |
| 14. Medtr_GRF | | 61 | 44 | 34 | 38 | 36 | 65 | 34 | 31 | 36 | 38 | 63 | 44 | 40 | ■ |
| 15. Medtr_GRF\like | | 37 | 27 | 32 | 33 | 46 | 37 | 33 | 31 | 34 | 37 | 37 | 37 | 34 | 36 |
| 16. Orysa_GRF_NM_001054270.1 | | 27 | 37 | 23 | 31 | 25 | 24 | 23 | 24 | 24 | 28 | 25 | 29 | 32 | 27 |
| 17. Orysa_GRF_NM_001060298.1 | | 53 | 35 | 36 | 44 | 35 | 46 | 35 | 32 | 35 | 42 | 46 | 78 | 41 | 48 |
| 18. Orysa_GRF_NM_001066126.1 | | 27 | 38 | 24 | 29 | 28 | 29 | 23 | 26 | 25 | 26 | 28 | 30 | 31 | 29 |
| 19. Orysa_GRF_Os02g47280.2 | | 51 | 38 | 36 | 47 | 36 | 46 | 36 | 35 | 35 | 39 | 49 | 73 | 44 | 47 |
| 20. Orysa_GRF_Os02g53690.1 | | 57 | 38 | 36 | 43 | 36 | 52 | 33 | 32 | 34 | 36 | 52 | 49 | 40 | 52 |
| 21. Orysa_GRF_Os03g51970.1 | | 40 | 31 | 49 | 40 | 39 | 40 | 37 | 29 | 45 | 40 | 40 | 38 | 38 | 40 |
| 22. Orysa_GRF_Os04g48510.1 | | 29 | 41 | 26 | 30 | 28 | 26 | 24 | 27 | 26 | 31 | 28 | 31 | 33 | 30 |
| 23. Orysa_GRF_Os04g51190.1 | | 52 | 35 | 35 | 44 | 34 | 45 | 36 | 32 | 34 | 41 | 46 | 79 | 41 | 44 |
| 24. Orysa_GRF_Os06g02560.1 | | 52 | 38 | 32 | 38 | 37 | 41 | 33 | 29 | 33 | 40 | 45 | 56 | 40 | 46 |
| 25. Orysa_GRF_Os11g35030.1 | | 38 | 32 | 43 | 37 | 36 | 38 | 35 | 34 | 40 | 38 | 38 | 38 | 39 | 35 |
| 26. Orysa_GRF_Os12g29980.1 | | 39 | 33 | 46 | 40 | 37 | 40 | 35 | 37 | 43 | 39 | 40 | 41 | 40 | 38 |
| 27. Oyrsa_GRF_Os03g47140.1 | | 37 | 30 | 39 | 40 | 40 | 37 | 35 | 34 | 36 | 40 | 42 | 39 | 38 | 32 |
| 28. Poptr_GRF_lcl_scaff_28.10 | | 67 | 43 | 34 | 40 | 39 | 52 | 37 | 31 | 34 | 37 | 55 | 53 | 42 | 60 |
| 29. Poptr_GRF_lcl_scaff_28.309 | | 40 | 32 | 36 | 65 | 33 | 38 | 46 | 33 | 35 | 42 | 38 | 42 | 59 | 41 |
| 30. Poptr_GRF_lcl_scaff_I.1018 | | 62 | 43 | 32 | 39 | 35 | 58 | 35 | 29 | 32 | 42 | 59 | 45 | 39 | 71 |
| 31. Poptr_GRF_lcl_scaff_I.688 | | 32 | 25 | 39 | 36 | 32 | 31 | 37 | 46 | 38 | 35 | 32 | 35 | 38 | 33 |
| 32. Poptr_GRF_lcl_scaff_I.995 | | 26 | 34 | 22 | 27 | 24 | 24 | 20 | 22 | 22 | 28 | 25 | 26 | 28 | 28 |
| 33. Poptr_GRF_lcl_scaff_II.1070 | | 31 | 24 | 59 | 36 | 32 | 33 | 39 | 35 | 54 | 34 | 31 | 34 | 33 | 32 |
| 34. Poptr_GRF_lcl_scaff_III.741 | | 52 | 38 | 34 | 38 | 36 | 45 | 32 | 31 | 33 | 36 | 45 | 53 | 38 | 48 |
| 35. Poptr_GRF_lcl_scaff_VII.1274 | | 38 | 25 | 57 | 37 | 34 | 35 | 41 | 37 | 58 | 37 | 34 | 35 | 36 | 34 |
| 36. Poptr_GRF_lcl_scaff_XII.277 | | 34 | 25 | 40 | 37 | 33 | 33 | 37 | 42 | 44 | 38 | 33 | 33 | 34 | 32 |
| 37. Poptr_GRF_lcl_scaff_XIII.769 | | 57 | 42 | 32 | 42 | 38 | 46 | 32 | 30 | 34 | 34 | 46 | 53 | 39 | 53 |
| 38. Poptr_GRF_lcl_scaff_XIV.174 | | 33 | 25 | 36 | 35 | 43 | 35 | 39 | 34 | 36 | 35 | 35 | 35 | 35 | 35 |
| 39. Poptr_GRF_lcl_scaff_XIV.39 | | 34 | 22 | 59 | 36 | 33 | 32 | 38 | 34 | 55 | 35 | 30 | 34 | 36 | 32 |

TABLE B1-continued

MatGAT results for global similarity and identity over the full length of the polypeptide sequences related to GRF.

| | | | | | | | | | | | | | | |
|---|---|---|---|---|---|---|---|---|---|---|---|---|---|---|
| 40. Poptr_GRF_lcl_scaff_XIV.51 | 37 | 27 | 60 | 41 | 35 | 35 | 42 | 40 | 54 | 37 | 36 | 37 | 36 | 37 |
| 41. Poptr_GRF_lcl_scaff_XIX.480 | 54 | 42 | 32 | 40 | 35 | 44 | 31 | 28 | 32 | 36 | 47 | 51 | 38 | 49 |
| 42. Sacof_GRF | 37 | 28 | 41 | 39 | 37 | 39 | 37 | 35 | 39 | 36 | 41 | 37 | 40 | 35 |
| 43. Vitvi_GRF | 70 | 43 | 35 | 41 | 35 | 56 | 33 | 32 | 33 | 37 | 58 | 48 | 39 | 69 |
| 44. Zeama_GRF10_EF515849.1 | 26 | 36 | 23 | 29 | 27 | 27 | 23 | 26 | 25 | 26 | 26 | 31 | 32 | 26 |
| 45. Zeama_GRF11_EF515850.1 | 50 | 41 | 29 | 41 | 33 | 42 | 28 | 25 | 30 | 35 | 42 | 44 | 35 | 45 |
| 46. Zeama_GRF12_EF515851.1 | 44 | 38 | 31 | 40 | 32 | 41 | 30 | 30 | 30 | 39 | 44 | 46 | 38 | 42 |
| 47. Zeama_GRF13_EF515852.1 | 37 | 29 | 39 | 40 | 37 | 40 | 36 | 37 | 39 | 36 | 38 | 40 | 37 | 35 |
| 48. Zeama_GRF14_EF515853.1 | 49 | 36 | 33 | 45 | 36 | 43 | 35 | 30 | 33 | 42 | 42 | 53 | 42 | 43 |
| 49. Zeama_GRF1_EF515840.1 | 50 | 35 | 38 | 47 | 37 | 47 | 36 | 34 | 34 | 39 | 45 | 67 | 41 | 43 |
| 50. Zeama_GRF2_EF515841.1 | 42 | 35 | 38 | 41 | 36 | 41 | 30 | 31 | 37 | 45 | 41 | 40 | 38 | 41 |
| 51. Zeama_GRF3_EF515842.1 | 51 | 36 | 33 | 41 | 38 | 49 | 34 | 27 | 31 | 36 | 49 | 45 | 40 | 46 |
| 52. Zeama_GRF4_EF515843.1 | 24 | 36 | 24 | 30 | 27 | 28 | 21 | 25 | 26 | 25 | 28 | 31 | 31 | 26 |
| 53. Zeama_GRF5_EF515844.1 | 50 | 35 | 35 | 42 | 35 | 42 | 34 | 32 | 34 | 40 | 43 | 75 | 40 | 41 |
| 54. Zeama_GRF6_EF515845.1 | 50 | 36 | 35 | 40 | 35 | 44 | 33 | 30 | 36 | 39 | 45 | 76 | 40 | 42 |
| 55. Zeama_GRF7_EF515846.1 | 48 | 41 | 31 | 39 | 34 | 44 | 29 | 27 | 31 | 37 | 45 | 42 | 35 | 47 |
| 56. Zeama_GRF8_EF515847.1 | 38 | 29 | 39 | 38 | 36 | 38 | 34 | 37 | 40 | 37 | 38 | 37 | 39 | 35 |
| 57. Zeama_GRF9_EF515848.1 | 57 | 42 | 31 | 37 | 31 | 49 | 32 | 29 | 31 | 32 | 50 | 45 | 40 | 52 |

| | 15 | 16 | 17 | 18 | 19 | 20 | 21 | 22 | 23 | 24 | 25 | 26 | 27 |
|---|---|---|---|---|---|---|---|---|---|---|---|---|---|
| 1. Aqufo_GRF | 23 | 18 | 34 | 15 | 33 | 41 | 29 | 18 | 34 | 35 | 23 | 23 | 23 |
| 2. Arath_GRF_AT2G06200.1 | 19 | 21 | 25 | 21 | 26 | 28 | 22 | 21 | 25 | 27 | 20 | 22 | 20 |
| 3. Arath_GRF_AT2G22840.1 | 20 | 16 | 24 | 15 | 26 | 23 | 32 | 21 | 24 | 22 | 30 | 31 | 28 |
| 4. Arath_GRF_AT2G36400.1 | 20 | 24 | 28 | 19 | 28 | 25 | 25 | 23 | 28 | 27 | 24 | 25 | 25 |
| 5. Arath_GRF_AT2G45480.1 | 29 | 16 | 23 | 16 | 21 | 22 | 23 | 17 | 22 | 24 | 18 | 22 | 21 |
| 6. Arath_GRF_AT3G13960.1 | 21 | 16 | 29 | 16 | 29 | 35 | 26 | 17 | 28 | 27 | 23 | 25 | 22 |
| 7. Arath_GRF_AT3G52910.1 | 19 | 17 | 22 | 15 | 23 | 21 | 23 | 18 | 22 | 20 | 23 | 22 | 22 |
| 8. Arath_GRF_AT4G24150.1 | 16 | 17 | 21 | 18 | 23 | 19 | 17 | 18 | 22 | 20 | 22 | 23 | 20 |
| 9. Arath_GRF_AT4G37740.1 | 20 | 18 | 23 | 17 | 24 | 21 | 27 | 19 | 24 | 24 | 29 | 29 | 26 |
| 10. Arath_GRF_AT5G53660.1 | 23 | 19 | 24 | 14 | 25 | 22 | 22 | 18 | 24 | 25 | 23 | 24 | 25 |
| 11. Brana_GRF | 21 | 16 | 29 | 15 | 31 | 35 | 26 | 18 | 29 | 28 | 21 | 24 | 24 |
| 12. Horvu_GRF | 23 | 21 | 68 | 20 | 62 | 29 | 24 | 22 | 70 | 42 | 25 | 28 | 25 |
| 13. Lyces_GRF | 21 | 25 | 25 | 18 | 27 | 22 | 24 | 25 | 25 | 25 | 23 | 26 | 24 |
| 14. Medtr_GRF | 22 | 17 | 31 | 14 | 31 | 38 | 26 | 17 | 28 | 30 | 22 | 24 | 22 |
| 15. Medtr_GRF\like | ■ | 16 | 22 | 20 | 24 | 20 | 20 | 18 | 22 | 21 | 24 | 23 | 22 |
| 16. Orysa_GRF_NM_001054270.1 | 24 | ■ | 22 | 35 | 22 | 18 | 16 | 66 | 21 | 20 | 21 | 21 | 19 |
| 17. Orysa_GRF_NM_001060298.1 | 36 | 30 | ■ | 20 | 70 | 33 | 24 | 23 | 98 | 42 | 25 | 27 | 26 |
| 18. Orysa_GRF_NM_001066126.1 | 29 | 46 | 32 | ■ | 20 | 14 | 16 | 34 | 20 | 14 | 20 | 18 | 18 |
| 19. Orysa_GRF_Os02g47280.2 | 37 | 30 | 78 | 29 | ■ | 34 | 25 | 24 | 70 | 41 | 25 | 29 | 24 |
| 20. Orysa_GRF_Os02g53690.1 | 33 | 26 | 49 | 26 | 50 | ■ | 27 | 20 | 33 | 34 | 23 | 25 | 22 |

TABLE B1-continued

MatGAT results for global similarity and identity over the full length of the polypeptide sequences related to GRF.

| | | | | | | | | | | | | | |
|---|---|---|---|---|---|---|---|---|---|---|---|---|---|
| 21. Orysa_GRF_Os03g51970.1 | 38 | 23 | 38 | 24 | 40 | 40 | ■ | 18 | 24 | 25 | 28 | 38 | 25 |
| 22. Orysa_GRF_Os04g48510.1 | 28 | 71 | 32 | 47 | 32 | 29 | 24 | ■ | 23 | 22 | 23 | 22 | 19 |
| 23. Orysa_GRF_Os04g51190.1 | 35 | 29 | 98 | 31 | 78 | 50 | 37 | 32 | ■ | 42 | 24 | 27 | 26 |
| 24. Orysa_GRF_Os06g02560.1 | 34 | 28 | 54 | 24 | 55 | 47 | 35 | 32 | 54 | ■ | 24 | 25 | 23 |
| 25. Orysa_GRF_Os11g35030.1 | 37 | 27 | 37 | 29 | 40 | 39 | 45 | 29 | 39 | 36 | ■ | 37 | 28 |
| 26. Orysa_GRF_Os12g29980.1 | 39 | 27 | 41 | 28 | 42 | 37 | 55 | 29 | 41 | 37 | 54 | ■ | 28 |
| 27. Oyrsa_GRF_Os03g47140.1 | 38 | 26 | 36 | 28 | 37 | 35 | 44 | 27 | 40 | 34 | 43 | 48 | ■ |
| 28. Poptr_GRF_lcl_scaff_28.10 | 37 | 24 | 55 | 27 | 53 | 55 | 40 | 27 | 55 | 48 | 38 | 38 | 38 |
| 29. Poptr_GRF_lcl_scaff_28.309 | 33 | 30 | 40 | 32 | 41 | 39 | 34 | 33 | 41 | 42 | 39 | 40 | 39 |
| 30. Poptr_GRF_lcl_scaff_I.1018 | 33 | 27 | 50 | 28 | 48 | 52 | 40 | 31 | 48 | 48 | 38 | 37 | 35 |
| 31. Poptr_GRF_lcl_scaff_I.688 | 33 | 22 | 34 | 26 | 36 | 33 | 36 | 24 | 34 | 33 | 34 | 37 | 37 |
| 32. Poptr_GRF_lcl_scaff_I.995 | 22 | 51 | 26 | 42 | 27 | 27 | 21 | 50 | 26 | 28 | 25 | 24 | 24 |
| 33. Poptr_GRF_lcl_scaff_II.1070 | 33 | 21 | 33 | 24 | 34 | 33 | 50 | 24 | 33 | 31 | 40 | 46 | 39 |
| 34. Poptr_GRF_lcl_scaff_III.741 | 38 | 28 | 53 | 27 | 50 | 43 | 38 | 32 | 53 | 58 | 38 | 40 | 36 |
| 35. Poptr_GRF_lcl_scaff_VII.1274 | 33 | 22 | 36 | 25 | 36 | 34 | 52 | 25 | 37 | 32 | 41 | 46 | 41 |
| 36. Poptr_GRF_lcl_scaff_XII.277 | 33 | 22 | 32 | 24 | 35 | 32 | 37 | 22 | 33 | 31 | 36 | 37 | 35 |
| 37. Poptr_GRF_lcl_scaff_XIII.769 | 35 | 31 | 57 | 26 | 57 | 48 | 37 | 35 | 56 | 57 | 38 | 39 | 38 |
| 38. Poptr_GRF_lcl_scaff_XIV.174 | 42 | 23 | 31 | 25 | 36 | 34 | 37 | 25 | 32 | 34 | 33 | 35 | 35 |
| 39. Poptr_GRF_lcl_scaff_XIV.39 | 32 | 21 | 32 | 24 | 33 | 33 | 47 | 22 | 32 | 30 | 38 | 42 | 38 |
| 40. Poptr_GRF_lcl_scaff_XIV.51 | 37 | 22 | 36 | 23 | 35 | 40 | 57 | 24 | 38 | 36 | 43 | 52 | 40 |
| 41. Poptr_GRF_lcl_scaff_XIX.480 | 32 | 33 | 54 | 28 | 52 | 47 | 35 | 34 | 53 | 53 | 35 | 37 | 35 |
| 42. Sacof_GRF | 37 | 27 | 37 | 28 | 38 | 35 | 43 | 30 | 40 | 35 | 45 | 46 | 82 |
| 43. Vitvi_GRF | 34 | 26 | 51 | 24 | 50 | 58 | 40 | 29 | 51 | 50 | 38 | 40 | 36 |
| 44. Zeama_GRF10_EF515849.1 | 30 | 44 | 32 | 81 | 32 | 22 | 24 | 44 | 32 | 28 | 30 | 28 | 29 |
| 45. Zeama_GRF11_EF515850.1 | 33 | 31 | 46 | 30 | 45 | 53 | 35 | 35 | 46 | 47 | 35 | 36 | 33 |
| 46. Zeama_GRF12_EF515851.1 | 31 | 32 | 46 | 33 | 45 | 40 | 34 | 32 | 45 | 67 | 36 | 35 | 34 |
| 47. Zeama_GRF13_EF515852.1 | 38 | 26 | 39 | 29 | 41 | 35 | 44 | 28 | 40 | 36 | 43 | 47 | 78 |
| 48. Zeama_GRF14_EF515853.1 | 34 | 28 | 55 | 27 | 54 | 47 | 40 | 30 | 54 | 77 | 39 | 36 | 39 |
| 49. Zeama_GRF1_EF515840.1 | 38 | 29 | 74 | 29 | 79 | 51 | 42 | 30 | 74 | 50 | 40 | 41 | 43 |
| 50. Zeama_GRF2_EF515841.1 | 39 | 29 | 43 | 31 | 40 | 40 | 46 | 33 | 43 | 42 | 66 | 54 | 42 |
| 51. Zeama_GRF3_EF515842.1 | 36 | 27 | 48 | 25 | 50 | 80 | 38 | 29 | 48 | 46 | 37 | 39 | 33 |
| 52. Zeama_GRF4_EF515843.1 | 28 | 45 | 31 | 80 | 32 | 27 | 24 | 44 | 32 | 26 | 30 | 27 | 29 |
| 53. Zeama_GRF5_EF515844.1 | 36 | 31 | 80 | 31 | 72 | 48 | 38 | 32 | 80 | 54 | 38 | 41 | 39 |
| 54. Zeama_GRF6_EF515845.1 | 37 | 30 | 80 | 32 | 71 | 46 | 38 | 31 | 81 | 51 | 38 | 39 | 36 |
| 55. Zeama_GRF7_EF515846.1 | 32 | 32 | 46 | 31 | 45 | 54 | 35 | 34 | 45 | 48 | 34 | 36 | 35 |
| 56. Zeama_GRF8_EF515847.1 | 38 | 27 | 37 | 30 | 38 | 35 | 43 | 28 | 39 | 34 | 46 | 44 | 79 |

TABLE B1-continued

MatGAT results for global similarity and identity over the
full length of the polypeptide sequences related to GRF.

| | | | | | | | | | | | | | | |
|---|---|---|---|---|---|---|---|---|---|---|---|---|---|---|
| 57. Zeama_GRF9_EF515848.1 | 35 | 31 | 45 | 27 | 45 | 73 | 40 | 31 | 45 | 46 | 35 | 39 | | 33 |

| | 28 | 29 | 30 | 31 | 32 | 33 | 34 | 35 | 36 | 37 | 38 | 39 | 40 | 41 | 42 |
|---|---|---|---|---|---|---|---|---|---|---|---|---|---|---|---|
| 1. Aqufo_GRF | 54 | 23 | 47 | 21 | 18 | 20 | 34 | 25 | 21 | 44 | 23 | 21 | 24 | 43 | 22 |
| 2. Arath_GRF_AT2G06200.1 | 34 | 22 | 32 | 16 | 24 | 16 | 27 | 17 | 15 | 30 | 19 | 15 | 18 | 30 | 20 |
| 3. Arath_GRF_AT2G22840.1 | 22 | 26 | 22 | 24 | 17 | 42 | 22 | 40 | 27 | 21 | 20 | 44 | 39 | 21 | 29 |
| 4. Arath_GRF_AT2G36400.1 | 23 | 51 | 27 | 26 | 20 | 25 | 25 | 27 | 23 | 27 | 22 | 25 | 27 | 27 | 27 |
| 5. Arath_GRF_AT2G45480.1 | 22 | 19 | 23 | 18 | 17 | 17 | 23 | 21 | 19 | 24 | 28 | 20 | 21 | 23 | 19 |
| 6. Arath_GRF_AT3G13960.1 | 36 | 21 | 41 | 20 | 17 | 22 | 27 | 23 | 21 | 31 | 22 | 22 | 25 | 30 | 24 |
| 7. Arath_GRF_AT3G52910.1 | 24 | 37 | 22 | 22 | 14 | 23 | 22 | 22 | 21 | 23 | 23 | 22 | 25 | 21 | 22 |
| 8. Arath_GRF_AT4G24150.1 | 19 | 22 | 20 | 32 | 15 | 21 | 19 | 20 | 25 | 20 | 17 | 20 | 22 | 18 | 21 |
| 9. Arath_GRF_AT4G37740.1 | 21 | 24 | 23 | 24 | 17 | 38 | 21 | 42 | 27 | 23 | 19 | 42 | 35 | 23 | 27 |
| 10. Arath_GRF_AT5G53660.1 | 22 | 28 | 26 | 24 | 18 | 22 | 22 | 25 | 27 | 23 | 21 | 23 | 24 | 23 | 25 |
| 11. Brana_GRF | 37 | 21 | 44 | 19 | 17 | 20 | 30 | 22 | 21 | 31 | 23 | 21 | 24 | 31 | 24 |
| 12. Horvu_GRF | 32 | 25 | 30 | 21 | 21 | 23 | 35 | 23 | 23 | 39 | 21 | 22 | 26 | 38 | 24 |
| 13. Lyces_GRF | 22 | 45 | 26 | 25 | 21 | 23 | 24 | 25 | 23 | 25 | 22 | 25 | 24 | 25 | 24 |
| 14. Medtr_GRF | 43 | 24 | 56 | 22 | 18 | 22 | 29 | 22 | 21 | 36 | 23 | 21 | 23 | 35 | 23 |
| 15. Medtr_GRF\like | 22 | 19 | 20 | 21 | 16 | 19 | 25 | 20 | 21 | 23 | 29 | 19 | 22 | 22 | 21 |
| 16. Orysa_GRF_NM_001054270.1 | 16 | 23 | 18 | 18 | 38 | 16 | 19 | 16 | 16 | 21 | 18 | 16 | 17 | 21 | 20 |
| 17. Orysa_GRF_NM_001060298.1 | 36 | 25 | 32 | 22 | 20 | 22 | 36 | 25 | 24 | 43 | 19 | 22 | 25 | 39 | 25 |
| 18. Orysa_GRF_NM_001066126.1 | 12 | 19 | 15 | 18 | 29 | 16 | 16 | 15 | 16 | 14 | 16 | 16 | 14 | 15 | 19 |
| 19. Orysa_GRF_Os02g47280.2 | 33 | 27 | 32 | 23 | 20 | 23 | 35 | 25 | 25 | 44 | 23 | 23 | 23 | 42 | 25 |
| 20. Orysa_GRF_Os02g53690.1 | 41 | 23 | 38 | 19 | 19 | 22 | 30 | 23 | 20 | 35 | 23 | 21 | 25 | 35 | 21 |
| 21. Orysa_GRF_Os03g51970.1 | 27 | 21 | 28 | 22 | 15 | 37 | 25 | 38 | 24 | 25 | 22 | 34 | 43 | 26 | 26 |
| 22. Orysa_GRF_Os04g48510.1 | 18 | 24 | 19 | 18 | 38 | 18 | 22 | 17 | 17 | 23 | 20 | 16 | 18 | 21 | 22 |
| 23. Orysa_GRF_Os04g51190.1 | 36 | 24 | 31 | 22 | 21 | 22 | 36 | 25 | 24 | 42 | 22 | 22 | 24 | 39 | 26 |
| 24. Orysa_GRF_Os06g02560.1 | 36 | 27 | 30 | 21 | 21 | 22 | 39 | 24 | 21 | 42 | 24 | 22 | 26 | 41 | 22 |
| 25. Orysa_GRF_Os11g35030.1 | 21 | 24 | 25 | 25 | 19 | 29 | 23 | 29 | 23 | 23 | 20 | 27 | 29 | 22 | 29 |
| 26. Orysa_GRF_Os12g29980.1 | 24 | 26 | 26 | 22 | 17 | 32 | 26 | 34 | 24 | 27 | 24 | 31 | 37 | 27 | 26 |
| 27. Oyrsa_GRF_Os03g47140.1 | 22 | 26 | 25 | 23 | 18 | 27 | 23 | 27 | 23 | 26 | 21 | 27 | 25 | 24 | 71 |
| 28. Poptr_GRF_lcl_scaff_28.10 | ■ | 25 | 44 | 21 | 19 | 23 | 35 | 24 | 22 | 41 | 22 | 21 | 25 | 39 | 22 |
| 29. Poptr_GRF_lcl_scaff_28.309 | 42 | ■ | 26 | 24 | 20 | 24 | 24 | 24 | 22 | 26 | 21 | 23 | 24 | 25 | 25 |
| 30. Poptr_GRFscaff_I.1018 | 59 | 39 | ■ | 22 | 20 | 19 | 32 | 23 | 22 | 36 | 21 | 21 | 23 | 36 | 23 |
| 31. Poptr_GRFscaff_I.688 | 36 | 33 | 31 | ■ | 16 | 25 | 20 | 25 | 29 | 20 | 21 | 24 | 24 | 21 | 25 |
| 32. Poptr_GRFscaff_I.995 | 25 | 29 | 28 | 21 | ■ | 14 | 19 | 16 | 13 | 22 | 17 | 14 | 15 | 21 | 18 |
| 33. Poptr_GRFscaff_II.1070 | 34 | 32 | 31 | 39 | 19 | ■ | 22 | 47 | 28 | 22 | 21 | 50 | 75 | 21 | 27 |
| 34. Poptr_GRFscaff_III.741 | 51 | 41 | 50 | 32 | 28 | 31 | ■ | 23 | 20 | 47 | 22 | 20 | 25 | 44 | 24 |
| 35. Poptr_GRFscaff_VII.1274 | 35 | 35 | 33 | 39 | 20 | 62 | 34 | ■ | 28 | 23 | 23 | 74 | 50 | 21 | 26 |

TABLE B1-continued

MatGAT results for global similarity and identity over the
full length of the polypeptide sequences related to GRF.

| | | | | | | | | | | | | | | |
|---|---|---|---|---|---|---|---|---|---|---|---|---|---|---|
| 36. Poptr_GRFscaff_XII.277 | 35 | 34 | 33 | 46 | 18 | 43 | 31 | 41 | ■ | 22 | 22 | 28 | 27 | 22 | 25 |
| 37. Poptr_GRFscaff_XIII.769 | 54 | 41 | 54 | 29 | 31 | 30 | 63 | 32 | 31 | ■ | 23 | 22 | 25 | 81 | 26 |
| 38. Poptr_GRFscaff_XIV.174 | 34 | 35 | 35 | 37 | 23 | 37 | 33 | 39 | 39 | 33 | ■ | 23 | 24 | 25 | 20 |
| 39. Poptr_GRFscaff_XIV.39 | 33 | 31 | 30 | 36 | 19 | 68 | 30 | 78 | 40 | 30 | 37 | ■ | 45 | 21 | 25 |
| 40. Poptr_GRFscaff_XIV.51 | 38 | 34 | 34 | 41 | 20 | 79 | 35 | 66 | 45 | 34 | 41 | 61 | ■ | 22 | 26 |
| 41. Poptr_GRFscaff_XIX.480 | 52 | 39 | 53 | 30 | 31 | 30 | 59 | 31 | 29 | 88 | 31 | 30 | 32 | ■ | 22 |
| 42. Sacof_GRF | 38 | 39 | 35 | 38 | 24 | 40 | 40 | 40 | 38 | 37 | 33 | 37 | 42 | 35 | ■ |
| 43. Vitvi_GRF | 65 | 40 | 70 | 31 | 27 | 30 | 51 | 34 | 32 | 54 | 34 | 31 | 37 | 53 | 36 |
| 44. Zeama_GRF10_EF515849 | 25 | 34 | 25 | 24 | 41 | 23 | 25 | 23 | 24 | 28 | 24 | 22 | 24 | 26 | 28 |
| 45. Zeama_GRF11_EF515850 | 49 | 38 | 46 | 29 | 29 | 28 | 46 | 31 | 29 | 50 | 30 | 27 | 31 | 48 | 34 |
| 46. Zeama_GRF12_EF515851 | 45 | 39 | 45 | 30 | 32 | 27 | 50 | 31 | 30 | 52 | 32 | 28 | 33 | 48 | 36 |
| 47. Zeama_GRF13_EF515852 | 37 | 37 | 34 | 37 | 23 | 41 | 38 | 39 | 38 | 37 | 34 | 38 | 42 | 35 | 90 |
| 48. Zeama_GRF14_EF515853 | 50 | 41 | 45 | 35 | 28 | 32 | 52 | 33 | 32 | 52 | 35 | 31 | 36 | 48 | 38 |
| 49. Zeama_GRF1_EF515840 | 49 | 42 | 45 | 37 | 25 | 37 | 46 | 38 | 37 | 52 | 36 | 34 | 41 | 50 | 42 |
| 50. Zeama_GRF2_EF515841 | 40 | 36 | 43 | 33 | 29 | 39 | 41 | 40 | 35 | 42 | 33 | 38 | 41 | 38 | 40 |
| 51. Zeama_GRF3_EF515842 | 53 | 39 | 49 | 33 | 25 | 30 | 41 | 33 | 31 | 45 | 34 | 29 | 33 | 43 | 35 |
| 52. Zeama_GRF4_EF515843 | 25 | 32 | 28 | 26 | 41 | 24 | 27 | 23 | 24 | 28 | 25 | 23 | 24 | 30 | 27 |
| 53. Zeama_GRF5_EF515844.1 | 52 | 41 | 45 | 34 | 26 | 33 | 49 | 35 | 33 | 52 | 34 | 33 | 35 | 52 | 38 |
| 54. Zeama_GRF6_EF515845.1 | 51 | 41 | 43 | 33 | 26 | 33 | 51 | 35 | 33 | 53 | 33 | 32 | 36 | 51 | 37 |
| 55. Zeama_GRF7_EF515846.1 | 47 | 36 | 49 | 31 | 30 | 28 | 48 | 31 | 29 | 49 | 29 | 27 | 32 | 47 | 35 |
| 56. Zeama_GRF8_EF515847.1 | 38 | 38 | 36 | 37 | 23 | 39 | 37 | 40 | 37 | 35 | 33 | 38 | 41 | 35 | 94 |
| 57. Zeama_GRF9_EF515848.1 | 52 | 39 | 52 | 30 | 27 | 31 | 45 | 32 | 29 | 47 | 32 | 28 | 36 | 45 | 35 |

| | 43 | 44 | 45 | 46 | 47 | 48 | 49 | 50 | 51 | 52 | 53 | 54 | 55 | 56 | 57 |
|---|---|---|---|---|---|---|---|---|---|---|---|---|---|---|---|
| 1. Aqufo_GRF | 57 | 15 | 34 | 28 | 23 | 33 | 34 | 25 | 37 | 13 | 32 | 32 | 33 | 22 | 38 |
| 2. Arath_GRF_AT2G06200.1 | 32 | 20 | 29 | 27 | 20 | 26 | 24 | 23 | 27 | 20 | 27 | 25 | 28 | 20 | 30 |
| 3. Arath_GRF_AT2G22840.1 | 23 | 16 | 21 | 22 | 29 | 23 | 25 | 29 | 21 | 15 | 25 | 24 | 21 | 30 | 22 |
| 4. Arath_GRF_AT2G36400.1 | 24 | 18 | 26 | 30 | 25 | 29 | 31 | 27 | 26 | 19 | 26 | 25 | 24 | 25 | 24 |
| 5. Arath_GRF_AT2G45480.1 | 23 | 17 | 21 | 21 | 18 | 25 | 22 | 21 | 21 | 17 | 21 | 20 | 22 | 19 | 19 |
| 6. Arath_GRF_AT3G13960.1 | 40 | 15 | 29 | 26 | 23 | 28 | 29 | 25 | 33 | 15 | 28 | 29 | 31 | 23 | 33 |
| 7. Arath_GRF_AT3G52910.1 | 21 | 14 | 19 | 21 | 22 | 22 | 24 | 22 | 21 | 14 | 21 | 20 | 20 | 23 | 20 |
| 8. Arath_GRF_AT4G24150.1 | 19 | 19 | 17 | 22 | 22 | 21 | 22 | 20 | 17 | 17 | 22 | 22 | 18 | 22 | 18 |
| 9. Arath_GRF_AT4G37740.1 | 22 | 15 | 20 | 21 | 29 | 23 | 24 | 28 | 20 | 16 | 23 | 22 | 21 | 28 | 20 |
| 10. Arath_GRF_AT5G53660.1 | 22 | 14 | 22 | 24 | 24 | 25 | 24 | 24 | 21 | 13 | 26 | 23 | 22 | 24 | 21 |
| 11. Brana_GRF | 41 | 13 | 29 | 27 | 25 | 26 | 30 | 24 | 34 | 13 | 28 | 28 | 30 | 23 | 34 |
| 12. Horvu_GRF | 31 | 20 | 31 | 35 | 25 | 38 | 54 | 26 | 30 | 19 | 63 | 64 | 30 | 23 | 29 |
| 13. Lyces_GRF | 20 | 20 | 23 | 27 | 25 | 25 | 23 | 25 | 23 | 19 | 25 | 24 | 23 | 24 | 24 |
| 14. Medtr_GRF | 53 | 12 | 30 | 26 | 22 | 27 | 29 | 25 | 33 | 13 | 28 | 27 | 32 | 22 | 35 |
| 15. Medtr_GRF\like | 21 | 19 | 20 | 21 | 21 | 22 | 22 | 24 | 22 | 20 | 25 | 25 | 20 | 21 | 23 |
| 16. Orysa_GRF_NM_001054270.1 | 17 | 36 | 21 | 23 | 21 | 20 | 23 | 22 | 18 | 34 | 23 | 21 | 22 | 20 | 20 |

TABLE B1-continued

MatGAT results for global similarity and identity over the full length of the polypeptide sequences related to GRF.

| | | | | | | | | | | | | | | | |
|---|---|---|---|---|---|---|---|---|---|---|---|---|---|---|---|
| 17. Orysa_GRF_NM_001060298.1 | 34 | 19 | 34 | 37 | 26 | 41 | 63 | 28 | 35 | 18 | 69 | 68 | 35 | 26 | 32 |
| 18. Orysa_GRF_NM_001066126.1 | 15 | 73 | 17 | 20 | 19 | 15 | 19 | 19 | 15 | 73 | 19 | 20 | 20 | 18 | 19 |
| 19. Orysa_GRF_Os02g47280.2 | 34 | 20 | 32 | 35 | 28 | 41 | 72 | 26 | 32 | 20 | 61 | 59 | 31 | 25 | 31 |
| 20. Orysa_GRF_Os02g53690.1 | 42 | 15 | 43 | 30 | 22 | 32 | 36 | 26 | 69 | 16 | 33 | 33 | 43 | 21 | 64 |
| 21. Orysa_GRF_Os03g51970.1 | 27 | 14 | 25 | 25 | 26 | 27 | 27 | 30 | 26 | 14 | 25 | 25 | 27 | 26 | 28 |
| 22. Orysa_GRF_Os04g48510.1 | 19 | 34 | 21 | 23 | 21 | 23 | 24 | 26 | 19 | 32 | 23 | 21 | 22 | 20 | 20 |
| 23. Orysa_GRF_Os04g51190.1 | 34 | 19 | 34 | 36 | 26 | 41 | 62 | 28 | 34 | 19 | 71 | 69 | 35 | 26 | 32 |
| 24. Orysa_GRF_Os06g02560.1 | 33 | 15 | 35 | 57 | 24 | 68 | 39 | 27 | 34 | 14 | 42 | 41 | 36 | 23 | 33 |
| 25. Orysa_GRF_Os11g35030.1 | 23 | 18 | 23 | 23 | 29 | 25 | 24 | 55 | 22 | 18 | 24 | 24 | 22 | 29 | 21 |
| 26. Orysa_GRF_Os12g29980.1 | 27 | 16 | 25 | 24 | 28 | 24 | 27 | 42 | 25 | 16 | 28 | 26 | 25 | 26 | 25 |
| 27. Oyrsa_GRF_Os03g47140.1 | 22 | 15 | 24 | 24 | 65 | 25 | 26 | 28 | 22 | 17 | 25 | 25 | 23 | 67 | 22 |
| 28. Poptr_GRF_lcl_scaff_28.10 | 52 | 14 | 35 | 28 | 25 | 35 | 32 | 25 | 37 | 14 | 33 | 31 | 33 | 23 | 38 |
| 29. Poptr_GRF_lcl_scaff_28.309 | 25 | 19 | 24 | 27 | 25 | 25 | 25 | 23 | 23 | 19 | 25 | 24 | 24 | 25 | 24 |
| 30. Poptr_GRFscaff_I.1018 | 56 | 14 | 34 | 31 | 24 | 31 | 33 | 29 | 36 | 14 | 30 | 30 | 34 | 24 | 37 |
| 31. Poptr_GRFscaff_I.688 | 21 | 16 | 20 | 21 | 25 | 23 | 25 | 22 | 20 | 16 | 25 | 21 | 21 | 24 | 19 |
| 32. Poptr_GRFscaff_I.995 | 19 | 30 | 21 | 23 | 17 | 20 | 19 | 21 | 18 | 29 | 20 | 20 | 22 | 17 | 18 |
| 33. Poptr_GRFscaff_II.1070 | 21 | 15 | 20 | 20 | 27 | 22 | 24 | 28 | 20 | 16 | 23 | 22 | 19 | 25 | 20 |
| 34. Poptr_GRFscaff_III.741 | 33 | 15 | 30 | 34 | 25 | 36 | 32 | 25 | 29 | 16 | 35 | 36 | 30 | 24 | 32 |
| 35. Poptr_GRFscaff_VII.1274 | 25 | 15 | 22 | 22 | 25 | 23 | 26 | 31 | 21 | 16 | 25 | 25 | 22 | 25 | 21 |
| 36. Poptr_GRFscaff_XII.277 | 22 | 17 | 19 | 20 | 24 | 22 | 23 | 22 | 20 | 16 | 24 | 24 | 19 | 25 | 18 |
| 37. Poptr_GRFscaff_XIII.769 | 41 | 13 | 33 | 35 | 25 | 40 | 39 | 26 | 33 | 13 | 41 | 40 | 32 | 25 | 34 |
| 38. Poptr_GRFscaff_XIV.174 | 22 | 18 | 20 | 23 | 21 | 23 | 23 | 21 | 21 | 18 | 22 | 23 | 19 | 19 | 21 |
| 39. Poptr_GRFscaff_XIV.39 | 21 | 14 | 19 | 21 | 25 | 22 | 23 | 28 | 19 | 14 | 24 | 23 | 19 | 26 | 19 |
| 40. Poptr_GRFscaff_XIV.51 | 24 | 16 | 23 | 23 | 25 | 24 | 26 | 30 | 24 | 14 | 25 | 25 | 22 | 25 | 23 |
| 41. Poptr_GRFscaff_XIX.480 | 39 | 15 | 30 | 33 | 24 | 37 | 37 | 26 | 32 | 17 | 40 | 40 | 32 | 22 | 32 |
| 42. Sacof_GRF | 22 | 18 | 22 | 25 | 86 | 24 | 25 | 30 | 22 | 17 | 27 | 26 | 23 | 91 | 21 |
| 43. Vitvi_GRF | ■ | 14 | 34 | 29 | 22 | 33 | 33 | 26 | 40 | 13 | 31 | 32 | 36 | 23 | 42 |
| 44. Zeama_GRF10_EF515849 | 27 | ■ | 17 | 21 | 17 | 14 | 19 | 18 | 15 | 86 | 19 | 19 | 19 | 18 | 16 |
| 45. Zeama_GRF11_EF515850 | 46 | 28 | ■ | 32 | 23 | 34 | 33 | 26 | 41 | 18 | 33 | 31 | 75 | 22 | 41 |
| 46. Zeama_GRF12_EF515851 | 45 | 33 | 46 | ■ | 27 | 61 | 33 | 24 | 29 | 20 | 34 | 34 | 32 | 24 | 31 |
| 47. Zeama_GRF13_EF515852 | 35 | 26 | 35 | 35 | ■ | 24 | 26 | 29 | 22 | 18 | 27 | 26 | 23 | 86 | 22 |
| 48. Zeama_GRF14_EF515853 | 48 | 25 | 45 | 67 | 38 | ■ | 38 | 26 | 33 | 15 | 40 | 39 | 34 | 24 | 34 |
| 49. Zeama_GRF1_EF515840 | 48 | 30 | 46 | 43 | 42 | 52 | ■ | 29 | 35 | 18 | 57 | 57 | 32 | 25 | 34 |
| 50. Zeama_GRF2_EF515841 | 42 | 30 | 39 | 36 | 41 | 42 | 42 | ■ | 23 | 19 | 28 | 26 | 27 | 30 | 24 |
| 51. Zeama_GRF3_EF515842 | 54 | 24 | 52 | 42 | 33 | 50 | 52 | 38 | ■ | 15 | 33 | 34 | 41 | 22 | 72 |

TABLE B1-continued

MatGAT results for global similarity and identity over the full length of the polypeptide sequences related to GRF.

| | | | | | | | | | | | | | | | |
|---|---|---|---|---|---|---|---|---|---|---|---|---|---|---|---|
| 52. Zeama_GRF4_EF515843 | 28 | 90 | 31 | 33 | 28 | 26 | 31 | 33 | 25 | ■ | 19 | 20 | 20 | 18 | 16 |
| 53. Zeama_GRF5_EF515844.1 | 47 | 32 | 46 | 44 | 38 | 53 | 68 | 43 | 47 | 31 | ■ | 87 | 33 | 27 | 31 |
| 54. Zeama_GRF6_EF515845.1 | 46 | 31 | 44 | 43 | 38 | 53 | 71 | 38 | 47 | 31 | 90 | ■ | 33 | 25 | 32 |
| 55. Zeama_GRF7_EF515846.1 | 51 | 32 | 83 | 46 | 35 | 47 | 44 | 38 | 52 | 31 | 47 | 43 | ■ | 23 | 40 |
| 56. Zeama_GRF8_EF515847.1 | 37 | 27 | 33 | 34 | 91 | 38 | 40 | 43 | 36 | 29 | 39 | 35 | 34 | ■ | 21 |
| 57. Zeama_GRF9_EF515848.1 | 59 | 25 | 54 | 43 | 35 | 48 | 44 | 39 | 79 | 27 | 45 | 44 | 54 | 33 | ■ |

The percentage identity between the full length polypeptide sequences useful in performing the methods of the invention can be as low as 15% amino acid identity compared to SEQ ID NO: 2.

The percentage identity can be substantially increased if the identity calculation is performed between the QLQ domain SEQ ID NO: 2 (as represented by SEQ ID NO: 115 comprised in SEQ ID NO: 2; QLQ domain of the GRF polypeptides of Table A represented in FIG. 2) and the QLQ domains of the polypeptides useful in performing the invention. Similarly, the percentage identity can be substantially increased if the identity calculation is performed between the WRC domain SEQ ID NO: 2 (as represented by SEQ ID NO: 116 comprised in SEQ ID NO: 2; WRC domain of the GRF polypeptides of Table A represented in FIG. 3) and the WRC domains of the polypeptides useful in performing the invention. Percentage identity over the QLQ domain amongst the polypeptide sequences useful in performing the methods of the invention ranges between 25% and 99% amino acid identity, and percentage identity over the WRC domain amongst the polypeptide sequences useful in performing the methods of the invention ranges between 60% and 99% amino acid identity. As can also be observed in FIG. 3, the WRC domain is better conserved than the QLQ domain amongst the different GRF polypeptides, as shown in FIG. 2.

The percentages in amino acid acid identity between the QLQ domains, and the percentage identity between the WRC domains are significantly higher than the percentage amino acid identity calculated between the full length GRF polypeptide sequences.

Results of the software analysis related to RAA1-like polypeptide are shown in Table B2 for the global similarity and identity over the full length of the polypeptide sequences. Percentage similarity is given above the diagonal and percentage identity is given below the diagonal (bold face).

The percentage identity between the RAA1-like polypeptide sequences useful in performing the methods of the invention can be as low as 31% amino acid identity compared to SEQ ID NO: 121, leaving Q9LXB6 (SEQ ID NO: 155) out of consideration.

TABLE B2

MatGAT results for global similarity and identity over the full length of the polypeptide sequences. SEQ ID NO: 121 is represented by Q9LGE3.

| | A2WN18 | A2XRE0 | Q6RIB0 | A3BNA1 | Q9LGE3 | Q5Q0B3 | Q0E1D7 | O24340 | Q8H475 |
|---|---|---|---|---|---|---|---|---|---|
| A2WN18 | | 63.6 | 73.4 | 70.6 | 100 | 46.4 | 67.2 | 74.5 | 68.8 |
| A2XRE0 | 50 | | 72 | 59.3 | 63.6 | 44.8 | 81.1 | 66.1 | 57.6 |
| Q6RIB0 | 59.6 | 57.6 | | 74.3 | 72.5 | 47.5 | 68 | 74.5 | 72.6 |
| A3BNA1 | 55.3 | 48.8 | 52.8 | | 70.6 | 39.8 | 60.7 | 64.5 | 95.3 |
| Q9LGE3 | 98.2 | 50.8 | 58.7 | 56.1 | | 46.4 | 67.2 | 73.6 | 68.8 |
| Q5Q0B3 | 39.8 | 32.4 | 37 | 32.1 | 39.8 | | 48.6 | 55.8 | 39.2 |
| Q0E1D7 | 54.9 | 76.2 | 58.2 | 46.4 | 55.7 | 37.4 | | 70.5 | 59.8 |
| O24340 | 58 | 45 | 60.9 | 46.1 | 58.9 | 44.5 | 53.2 | | 66.4 |
| Q8H475 | 53 | 47.1 | 51.4 | 95.3 | 53.9 | 31.9 | 45.6 | 45.7 | |
| Q0JEF5 | 50 | 99.2 | 57.6 | 48.8 | 50.8 | 32.4 | 76.2 | 45 | 47.1 |
| O49587 | 58.1 | 46.6 | 54 | 45.7 | 58.1 | 68.5 | 53.4 | 64.8 | 45.4 |
| A2X4J6 | 54.9 | 76.2 | 58.2 | 46.4 | 55.7 | 37.9 | 99.2 | 51.6 | 45.6 |
| Q7XX25 | 51.4 | 91.5 | 59.5 | 49.1 | 52.3 | 32.6 | 71.3 | 45.6 | 48.7 |
| Q8LR63 | 58.3 | 47 | 52 | 45.5 | 59.1 | 39.2 | 50.7 | 54.7 | 45.5 |
| Q9LXB5 | 58.9 | 46.7 | 56.2 | 45.3 | 58.9 | 46.2 | 52 | 79.6 | 44.9 |
| Q9LXB6 | 8.5 | 7.3 | 7.6 | 6.7 | 8.5 | 8.3 | 8.7 | 11.1 | 6.8 |
| O23624 | 58 | 45 | 59.1 | 47 | 58 | 45.6 | 52.4 | 92.7 | 44.8 |

| | Q0JEF5 | O49587 | A2X4J6 | Q7XX25 | Q8LR63 | Q9LXB5 | Q9LXB6 | O23624 |
|---|---|---|---|---|---|---|---|---|
| A2WN18 | 63.6 | 67.7 | 67.2 | 67 | 70.1 | 72.3 | 10.4 | 73.6 |
| A2XRE0 | 100 | 65.3 | 81.1 | 91.5 | 64.6 | 67.8 | 10.4 | 65.3 |
| Q6RIB0 | 72 | 69.4 | 68 | 76.9 | 65.4 | 71.4 | 10 | 74.5 |

TABLE B2-continued

MatGAT results for global similarity and identity over the full length of the polypeptide sequences. SEQ ID NO: 121 is represented by Q9LGE3.

| | | | | | | | | |
|---|---|---|---|---|---|---|---|---|
| A3BNA1 | 59.3 | 58.9 | 60.7 | 63 | 59.1 | 62.5 | 9.2 | 65.5 |
| Q9LGE3 | 63.6 | 67.7 | 67.2 | 67 | 70.1 | 72.3 | 10.4 | 72.7 |
| Q5Q0B3 | 44.8 | 68.5 | 48.6 | 43.6 | 49.7 | 55.2 | 13.9 | 54.7 |
| Q0E1D7 | 81.1 | 71 | 100 | 76.2 | 69.3 | 66.4 | 11.2 | 68.9 |
| O24340 | 66.1 | 81.5 | 68 | 68.2 | 70.9 | 90.2 | 12.6 | 98.2 |
| Q8H475 | 57.6 | 58.1 | 59.8 | 63 | 58.3 | 62.5 | 9.3 | 65.5 |
| Q0JEF5 | | 65.3 | 81.1 | 91.5 | 64.6 | 67.8 | 10.4 | 65.3 |
| O49587 | 46.6 | | 71 | 63.7 | 70.9 | 80.6 | 12.4 | 79.8 |
| A2X4J6 | 76.2 | 54.1 | | 76.2 | 69.3 | 67.2 | 11.3 | 68.9 |
| Q7XX25 | 91.5 | 47.6 | 71.3 | | 64.6 | 69.6 | 9.7 | 67.3 |
| Q8LR63 | 47 | 56.6 | 50.7 | 48.8 | | 70.1 | 11.3 | 70.1 |
| Q9LXB5 | 46.7 | 67.2 | 52 | 47.4 | 54.7 | | 13.8 | 89.3 |
| Q9LXB6 | 7.2 | 10 | 8.7 | 6.6 | 8.7 | 13.6 | | 12.3 |
| O23624 | 45 | 66.4 | 52.4 | 45.6 | 53.9 | 79.6 | 11.1 | |

The percentage identity between the polypeptide sequences related to SYR polypeptides useful in performing the methods of the invention can be as low as 27% amino acid identity compared to SEQ ID NO: 169.

TABLE B3

MatGAT results for global similarity and identity over the full length of the SYR polypeptide sequences.

| | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|
| 1. SEQID 169 | | 29.8 | 46.8 | 55.2 | 67.0 | 66.1 | 66.7 | 71.4 | 63.6 | 36.8 | 34.6 | 35.5 | 39.7 | 39.0 | 41.0 | 27.6 | 32.1 |
| 2. SEQID 179 | 40.4 | | 29.8 | 23.0 | 26.8 | 28.1 | 23.6 | 25.3 | 28.7 | 30.3 | 28.1 | 30.9 | 32.0 | 28.1 | 24.7 | 16.3 | 17.4 |
| 3. SEQID 180 | 57.9 | 39.3 | | 42.9 | 46.0 | 47.6 | 44.4 | 47.6 | 45.2 | 31.9 | 33.3 | 33.1 | 34.1 | 37.3 | 34.1 | 24.8 | 28.3 |
| 4. SEQID 181 | 59.0 | 32.0 | 50.8 | | 57.1 | 55.4 | 77.4 | 77.4 | 83.2 | 25.4 | 26.7 | 26.6 | 30.2 | 32.2 | 33.3 | 21.6 | 23.9 |
| 5. SEQID 182 | 80.9 | 41.0 | 57.9 | 69.1 | | 89.1 | 63.4 | 67.9 | 66.1 | 36.9 | 31.9 | 33.1 | 40.5 | 37.3 | 40.9 | 24.8 | 27.9 |
| 6. SEQID 183 | 79.1 | 38.2 | 59.5 | 65.5 | 95.5 | | 61.6 | 66.1 | 62.5 | 36.4 | 32.6 | 36.0 | 40.5 | 38.8 | 38.2 | 24.0 | 28.8 |
| 7. SEQID 184 | 69.5 | 34.8 | 57.1 | 78.1 | 72.7 | 69.1 | | 94.9 | 81.3 | 30.8 | 29.6 | 31.7 | 34.1 | 34.7 | 39.4 | 25.5 | 29.0 |
| 8. SEQID 185 | 74.3 | 37.1 | 60.3 | 80.0 | 77.3 | 73.6 | 94.9 | | 85.0 | 33.1 | 31.9 | 33.8 | 36.5 | 37.3 | 42.4 | 28.2 | 32.0 |
| 9. SEQID 186 | 69.2 | 39.3 | 56.3 | 86.0 | 78.2 | 74.5 | 84.1 | 88.8 | | 36.9 | 32.6 | 36.7 | 38.1 | 39.8 | 40.2 | 28.8 | 29.6 |
| 10. SEQID 187 | 54.6 | 41.6 | 56.9 | 46.2 | 57.7 | 60.8 | 50.0 | 53.1 | 54.6 | | 66.2 | 46.9 | 51.9 | 44.3 | 42.7 | 26.3 | 26.9 |
| 11. SEQID 188 | 51.9 | 44.4 | 56.3 | 47.4 | 54.8 | 54.8 | 50.4 | 53.3 | 52.6 | 77.8 | | 49.0 | 46.8 | 41.1 | 39.3 | 28.7 | 27.2 |
| 12. SEQID 189 | 54.0 | 43.8 | 54.7 | 45.3 | 53.2 | 54.0 | 49.6 | 51.8 | 54.7 | 65.5 | 65.5 | | 61.9 | 45.1 | 40.3 | 24.0 | 22.9 |
| 13. SEQID 190 | 58.7 | 45.5 | 55.6 | 50.0 | 60.3 | 59.5 | 54.8 | 57.1 | 63.5 | 66.9 | 66.7 | 77.7 | | 53.8 | 44.4 | 27.0 | 27.6 |
| 14. SEQID 191 | 61.9 | 42.7 | 57.9 | 55.1 | 58.5 | 53.6 | 61.0 | 63.6 | 62.7 | 60.6 | 64.4 | 68.3 | 77.0 | | 73.7 | 27.9 | 29.4 |
| 15. SEQID 192 | 62.9 | 35.4 | 50.0 | 53.3 | 60.0 | 58.2 | 66.7 | 69.7 | 61.7 | 56.2 | 54.8 | 54.7 | 60.3 | 73.7 | | 36.7 | 38.6 |
| 16. SEQID 201 | 45.7 | 25.3 | 38.1 | 38.1 | 39.1 | 40.0 | 45.5 | 48.5 | 44.9 | 40.0 | 40.7 | 36.0 | 41.3 | 41.5 | 56.3 | | 42.0 |
| 17. SEQID 202 | 50.5 | 30.3 | 45.2 | 40.0 | 46.4 | 44.5 | 47.5 | 50.5 | 45.8 | 34.6 | 42.2 | 36.7 | 40.5 | 42.4 | 55.2 | 57.7 | |

The percentage identity between the ARKL polypeptide sequences useful in performing the methods of the invention can be as low as 10% amino acid identity compared to SEQ ID NO: 213 (Orysa_ARKL1).

TABLE B4

MatGAT results for global similarity and identity over the full length of the ARKL polypeptide sequences.

| | 1 | 2 | 3 | 4 | 5 | 6 | 7 | 8 | 9 | 10 | 11 | 12 | 13 | 14 | 15 |
|---|---|---|---|---|---|---|---|---|---|---|---|---|---|---|---|
| 1. Orysa ARKL1 | | 25.6 | 19.2 | 22.9 | 26.4 | 21.5 | 22.6 | 21.3 | 16.6 | 19.6 | 25.1 | 20.4 | 64.7 | 18.0 | 18.8 |
| 2. Orysa ARKL3 | 34.8 | | 23.7 | 21.2 | 23.2 | 22.0 | 20.9 | 13.9 | 10.0 | 12.8 | 62.0 | 24.6 | 24.7 | 22.3 | 14.8 |
| 3. Orysa ARKL4 | 27.6 | 37.8 | | 23.0 | 17.9 | 22.3 | 21.8 | 14.0 | 9.6 | 12.0 | 25.1 | 27.3 | 19.1 | 27.8 | 11.0 |
| 4. Orysa ARKL5 | 38.1 | 36.2 | 35.1 | | 20.6 | 45.4 | 23.6 | 15.3 | 11.1 | 13.7 | 20.9 | 23.5 | 23.1 | 22.0 | 14.6 |
| 5. Orysa ARKL6 | 41.4 | 31.0 | 25.7 | 33.9 | | 21.0 | 22.4 | 21.6 | 24.2 | 18.6 | 22.9 | 19.5 | 25.1 | 16.6 | 19.8 |
| 6. Orysa ARKL7 | 33.4 | 35.5 | 34.6 | 57.0 | 30.6 | | 23.7 | 15.3 | 11.0 | 13.5 | 23.3 | 24.2 | 22.1 | 21.3 | 14.6 |
| 7. Orysa ARKL8 | 32.6 | 35.0 | 32.7 | 42.7 | 33.6 | 38.6 | | 14.6 | 11.6 | 14.2 | 20.6 | 24.0 | 21.8 | 20.7 | 11.9 |
| 8. Orysa ARKL9 | 35.1 | 24.3 | 21.7 | 24.6 | 32.1 | 25.0 | 25.6 | | 15.5 | 15.3 | 15.5 | 13.4 | 20.1 | 11.2 | 20.1 |
| 9. Zeama ARKL1 | 23.4 | 14.0 | 12.3 | 16.6 | 28.0 | 15.8 | 15.8 | 22.3 | | 43.2 | 10.1 | 8.4 | 15.5 | 7.3 | 17.1 |

TABLE B4-continued

MatGAT results for global similarity and identity over the full length of the ARKL polypeptide sequences.

| | 1 | 2 | 3 | 4 | 5 | 6 | 7 | 8 | 9 | 10 | 11 | 12 | 13 | 14 | 15 |
|---|---|---|---|---|---|---|---|---|---|---|---|---|---|---|---|
| 10. Zeama ARKL2 | 25.3 | 16.9 | 14.4 | 16.8 | 26.1 | 17.3 | 19.4 | 23.0 | 64.2 | | 11.9 | 17.3 | 18.2 | 11.5 | 19.0 |
| 11. Horvu ARKL1 | 35.7 | 73.4 | 38.6 | 38.1 | 33.0 | 38.3 | 35.2 | 23.5 | 14.3 | 15.8 | | 24.0 | 24.9 | 23.7 | 13.9 |
| 12. Horvu ARKL2 | 29.6 | 38.9 | 42.9 | 37.2 | 28.8 | 36.6 | 37.7 | 21.7 | 13.0 | 18.8 | 37.8 | | 20.3 | 32.5 | 12.3 |
| 13. Horvu ARKL3 | 76.5 | 34.3 | 27.1 | 35.1 | 40.1 | 32.5 | 31.2 | 32.6 | 22.5 | 23.5 | 35.1 | 28.6 | | 17.1 | 19.3 |
| 14. Glyma ARKL1 | 26.4 | 35.6 | 43.6 | 33.3 | 23.4 | 33.9 | 31.4 | 18.8 | 10.8 | 13.6 | 35.8 | 46.9 | 25.8 | | 11.3 |
| 15. Glyma ARKL2 | 31.6 | 21.6 | 19.0 | 23.8 | 29.9 | 22.0 | 23.0 | 32.5 | 26.0 | 30.5 | 20.4 | 19.1 | 31.0 | 16.8 | |
| 16. Musmu ARKL3 | 18.0 | 26.1 | 28.6 | 22.9 | 17.4 | 25.4 | 23.9 | 15.2 | 7.1 | 8.4 | 26.1 | 29.8 | 18.8 | 32.6 | 14.2 |

TABLE B5-1

MatGAT results for global similarity and identity over the DUF221 domain or domain fragment in a selection of YTP polypeptides from Table A.

| | YTP13_DUF221 | YTP16_DUF221 | YTP5_DUF221 | YTP12_DUF221 | YTP6_DUF221 |
|---|---|---|---|---|---|
| YTP13_DUF221 | | 81.1 | 59.3 | 58.8 | 56.2 |
| YTP16_DUF221 | 90.3 | | 63.0 | 63.0 | 58.8 |
| YTP5_DUF221 | 76.9 | 76.5 | | 84.0 | 60.4 |
| YTP12_DUF221 | 77.7 | 78.2 | 91.5 | | 60.2 |
| YTP6_DUF221 | 74.8 | 74.5 | 77.2 | 78.4 | |
| YTP18_DUF221 | 60.5 | 59.8 | 63.9 | 63.2 | 60.8 |
| YTP11_DUF221 | 61.8 | 62.0 | 63.1 | 64.8 | 64.6 |
| YTP19_DUF221 | 49.4 | 50.7 | 52.2 | 54.4 | 51.5 |
| YTP21_DUF221 | 59.0 | 58.1 | 60.7 | 63.4 | 59.3 |
| YTP3_DUF221 | 55.5 | 56.9 | 56.3 | 58.7 | 57.5 |
| YTP15_DUF221 | 48.8 | 49.3 | 50.0 | 52.9 | 51.7 |
| YTP9_DUF221 | 50.4 | 49.2 | 52.3 | 54.9 | 51.3 |
| YTP26_DUF221 | 36.1 | 34.8 | 35.4 | 37.0 | 34.4 |
| YTP4_DUF221 | 41.5 | 40.4 | 38.5 | 38.7 | 37.1 |
| YTP1_DUF221 | 16.1 | 14.7 | 16.0 | 19.7 | 17.5 |

| | YTP18_DUF221 | YTP11_DUF221 | YTP19_DUF221 | YTP21_DUF221 | YTP3_DUF221 |
|---|---|---|---|---|---|
| YTP13_DUF221 | 43.6 | 44.1 | 34.1 | 39.0 | 36.2 |
| YTP16_DUF221 | 42.6 | 45.5 | 34.5 | 37.6 | 37.7 |
| YTP5_DUF221 | 45.3 | 48.5 | 36.1 | 40.7 | 38.7 |
| YTP12_DUF221 | 43.3 | 49.8 | 37.9 | 40.5 | 38.3 |
| YTP6_DUF221 | 41.8 | 45.1 | 34.8 | 36.4 | 36.8 |
| YTP18_DUF221 | | 55.0 | 44.8 | 37.6 | 36.1 |
| YTP11_DUF221 | 71.4 | | 41.1 | 37.6 | 37.3 |
| YTP19_DUF221 | 59.3 | 56.4 | | 30.6 | 28.4 |
| YTP21_DUF221 | 54.0 | 56.4 | 47.0 | | 61.9 |
| YTP3_DUF221 | 54.2 | 56.7 | 46.7 | 77.6 | |
| YTP15_DUF221 | 47.6 | 49.0 | 38.0 | 49.0 | 49.3 |
| YTP9_DUF221 | 49.2 | 49.9 | 37.6 | 50.4 | 48.0 |
| YTP26_DUF221 | 38.9 | 38.7 | 33.9 | 36.3 | 36.1 |
| YTP4_DUF221 | 40.4 | 40.0 | 33.6 | 38.5 | 38.2 |
| YTP1_DUF221 | 14.0 | 15.6 | 18.2 | 15.2 | 15.9 |

| | YTP15_DUF221 | YTP9_DUF221 | YTP26_DUF221 | YTP4_DUF221 | YTP1_DUF221 |
|---|---|---|---|---|---|
| YTP13_DUF221 | 29.4 | 29.3 | 20.1 | 20.6 | 9.6 |
| YTP16_DUF221 | 30.3 | 30.3 | 18.6 | 19.1 | 9.0 |
| YTP5_DUF221 | 29.2 | 30.9 | 17.4 | 19.3 | 9.0 |
| YTP12_DUF221 | 32.2 | 32.8 | 17.7 | 18.9 | 11.2 |
| YTP6_DUF221 | 30.2 | 27.6 | 17.4 | 19.1 | 9.2 |
| YTP18_DUF221 | 26.4 | 28.4 | 19.8 | 21.4 | 7.3 |
| YTP11_DUF221 | 27.8 | 29.1 | 19.4 | 20.3 | 9.0 |
| YTP19_DUF221 | 21.3 | 21.4 | 18.6 | 16.2 | 11.1 |
| YTP21_DUF221 | 28.2 | 30.8 | 17.5 | 17.9 | 9.7 |
| YTP3_DUF221 | 28.1 | 28.3 | 17.4 | 18.0 | 8.9 |
| YTP15_DUF221 | | 59.8 | 18.5 | 17.9 | 16.8 |
| YTP9_DUF221 | 77.5 | | 20.8 | 19.7 | 29.3 |
| YTP26_DUF221 | 35.7 | 38.7 | | 68.6 | 9.2 |

TABLE B5-1-continued

MatGAT results for global similarity and identity over the DUF221 domain or
domain fragment in a selection of YTP polypeptides from Table A.

| | | | | | |
|---|---|---|---|---|---|
| YTP4_DUF221 | 37.4 | 37.8 | 83.6 | | 7.0 |
| YTP1_DUF221 | 23.0 | 30.4 | 15.5 | 13.8 | |

Table B5-2 shows the SEQ ID NO: corresponding to the sequences used in Table B5-1.

TABLE B5-2

DUF221 domains.

| Description | SEQ ID NO |
|---|---|
| YTP13_DUF221 | 530 |
| YTP16_DUF221 | 533 |
| YTP5_DUF221 | 522 |
| YTP12_DUF221 | 529 |
| YTP6_DUF221 | 523 |
| YTP18_DUF221 | 525 |
| YTP11_DUF221 | 528 |
| YTP19_DUF221 | 536 |
| YTP21_DUF221 | 538 |
| YTP3_DUF221 | 520 |
| YTP15_DUF221 | 532 |
| YTP9_DUF221 | 526 |
| YTP26_DUF221 | 543 |
| YTP4_DUF221 | 521 |
| YTP1_DUF221 | 518 |

Example 4

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Interpro is hosted at the European Bioinformatics Institute in the United Kingdom.

The results of the InterPro scan of the polypeptide sequence as represented by SEQ ID NO: 2 are presented in Table C.

TABLE C1

InterPro scan results of the polypeptide sequence as represented by SEQ ID NO: 2

| InterPro accession number and name | Integrated database name | Integrated database accession number | Integrated database accession name |
|---|---|---|---|
| IPR014977 WRC domain | PFAM | PF08879 | WRC |
| IPR014978 QLQ domain | PFAM | PF08880 | QLQ |

The results of the InterPro scan of the polypeptide sequence as represented by SEQ ID NO: 213 are presented in Table C1.

TABLE C2-1

InterPro scan results (major accession numbers) of the polypeptide sequence as represented by SEQ ID NO: 213.

| Query | InterPRO accession | Description accession interpro | Method search | Database searched | Accession in database | Amino acid coordinates on the Query sequence | evalue |
|---|---|---|---|---|---|---|---|
| Orysa_ARKL1 | IPR0013083 | Zinc finger, RING/FYVE/PHD-type | Gene3D | Gene3D | G3DSA: 3.30.40.10 | 315-365 | 1.5e−10 |
| Orysa_ARKL1 | IPR001841 | Zinc Finger, Ring-type | HMM Smart | Smart | SM00184 | 319-359 | 7.4e−07 |
| Orysa_ARKL1 | no IPR accession | RING FINGER PROTEIN 24-RELATED | HMM Panther | Panther | PTHR22766 | 316-365 | 9.6e−12 |
| Orysa_ARKL1 | IPR001841 | Zinc Finger, Ring-type | HMM Pfam | Pfam | PF00097 | 319-359 | 4.9e−09 |
| Orysa_ARKL1 | no IPR accession | NA* | HMM Pfam | Pfam | PF2828 | 266-296 | |

Table C2 gives the SEQ ID NO: comprising the conserved RING domain (ZfC3HC4) and DAR1 (PfamB2828) in the ARKL polypeptides of Table A.

TABLE C2-2

RING and DAR1 domains in ARKL polypeptides

| Domain | Reference Protein | SEQ ID NO: |
|---|---|---|
| ZfC3HC4_Orysa_ARKL1 | Orysa_ARKL1 | 306 |
| ZfC3HC4_Orysa_ARKL3 | Orysa_ARKL3 | 307 |
| ZfC3HC4_Orysa_ARKL4 | Orysa_ARKL4 | 308 |
| ZfC3HC4_Orysa_ARKL5 | Orysa_ARKL5 | 309 |
| ZfC3HC4_Orysa_ARKL6 | Orysa_ARKL6 | 310 |
| ZfC3HC4_Orysa_ARKL7 | Orysa_ARKL7 | 311 |

TABLE C2-2-continued

RING and DAR1 domains in ARKL polypeptides

| Domain | Reference Protein | SEQ ID NO: |
|---|---|---|
| ZfC3HC4_Orysa_ARKL8 | Orysa_ARKL8 | 312 |
| ZfC3HC4_Orysa_ARKL9 | Orysa_ARKL9 | 313 |
| ZfC3HC4_Zeama_ARKL1 | Zeama_ARKL1 | 314 |
| ZfC3HC4_Zeama_ARKL2 | Zeama_ARKL2 | 315 |
| ZfC3HC4_Horvu_ARKL1 | Horvu_ARKL1 | 316 |
| ZfC3HC4_Horvu_ARKL2 | Horvu_ARKL2 | 317 |
| ZfC3HC4_Horvu_ARKL3 | Horvu_ARKL3 | 318 |
| ZfC3HC4_Lyces_ARKL1 | Lyces_ARKL1 | 319 |
| ZfC3HC4_Lyces_ARKL2 | Lyces_ARKL2 | 320 |
| ZfC3HC4_Lyces_ARKL3 | Lyces_ARKL3 | 321 |
| ZfC3HC4_Glyma_ARKL1 | Glyma_ARKL1 | 322 |
| ZfC3HC4_Glyma_ARKL2 | Glyma_ARKL2 | 323 |
| ZfC3HC4_Zinel_ARKL1 | Zinel_ARKL1 | 324 |
| ZfC3HC4_Lotja_ARKL1 | Lotja_ARKL1 | 325 |
| ZfC3HC4_Arath_ARKL1 | Arath_ARKL1 | 326 |
| ZfC3HC4_Arath_ARKL2 | Arath_ARKL2 | 327 |
| ZfC3HC4_Arath_ARKL3 | Arath_ARKL3 | 328 |
| ZfC3HC4_Arath_ARKL4 | Arath_ARKL4 | 329 |
| ZfC3HC4_Arath_ARKL5 | Arath_ARKL5 | 330 |
| ZfC3HC4_Arath_ARKL6 | Arath_ARKL6 | 331 |
| ZfC3HC4_Arath_ARKL7 | Arath_ARKL7 | 332 |
| ZfC3HC4_Arath_ARKL8 | Arath_ARKL8 | 333 |
| ZfC3HC4_Arath_ARKL9 | Arath_ARKL9 | 334 |
| ZfC3HC4_Arath_ARKL10 | Arath_ARKL10 | 335 |
| ZfC3HC4_Arath_ARKL11 | Arath_ARKL11 | 336 |
| ZfC3HC4_Arath_ARKL12 | Arath_ARKL12 | 337 |
| ZfC3HC4_Poptr_ARKL1 | Poptr_ARKL1 | 338 |
| ZfC3HC4_Poptr_ARKL2 | Poptr_ARKL2 | 339 |
| ZfC3HC4_Poptr_ARKL3 | Poptr_ARKL3 | 340 |
| ZfC3HC4_Poptr_ARKL4 | Poptr_ARKL4 | 341 |
| ZfC3HC4_Poptr_ARKL5 | Poptr_ARKL5 | 342 |
| ZfC3HC4_Poptr_ARKL6 | Poptr_ARKL6 | 343 |
| ZfC3HC4_Poptr_ARKL7 | Poptr_ARKL7 | 344 |
| ZfC3HC4_Poptr_ARKL8 | Poptr_ARKL8 | 345 |
| ZfC3HC4_Poptr_ARKL9 | Poptr_ARKL9 | 346 |
| ZfC3HC4_Poptr_ARKL10 | Poptr_ARKL10 | 347 |
| ZfC3HC4_Medtr_ARKL1 | Medtr_ARKL1 | 348 |
| ZfC3HC4_Medtr_ARKL2 | Medtr_ARKL2 | 349 |
| ZfC3HC4_Medtr_ARKL3 | Medtr_ARKL3 | 350 |
| ZfC3HC4_Medtr_ARKL4 | Medtr_ARKL4 | 351 |
| PfamB2828_Orysa_ARKL1 | Orysa_ARKL1 | 352 |
| PfamB2828_Orysa_ARKL2 | Orysa_ARKL2 | 353 |
| PfamB2828_Orysa_ARKL3 | Orysa_ARKL3 | 354 |
| PfamB2828_Orysa_ARKL4 | Orysa_ARKL4 | 355 |
| PfamB2828_Orysa_ARKL5 | Orysa_ARKL5 | 356 |
| PfamB2828_Orysa_ARKL6 | Orysa_ARKL6 | 357 |
| PfamB2828_Orysa_ARKL7 | Orysa_ARKL7 | 358 |
| PfamB2828_Orysa_ARKL8 | Orysa_ARKL8 | 359 |
| PfamB2828_Orysa_ARKL9 | Orysa_ARKL9 | 360 |
| PfamB2828_Zeama_ARKL1 | Zeama_ARKL1 | 361 |
| PfamB2828_Zeama_ARKL2 | Zeama_ARKL2 | 362 |
| PfamB2828_Horvu_ARKL1 | Horvu_ARKL1 | 363 |
| PfamB2828_Horvu_ARKL2 | Horvu_ARKL2 | 364 |
| PfamB2828_Horvu_ARKL3 | Horvu_ARKL3 | 365 |
| PfamB2828_Lyces_ARKL1 | Lyces_ARKL1 | 366 |
| PfamB2828_Lyces_ARKL2 | Lyces_ARKL2 | 367 |
| PfamB2828_Lyces_ARKL3 | Lyces_ARKL3 | 368 |
| PfamB2828_Glyma_ARKL1 | Glyma_ARKL1 | 369 |
| PfamB2828_Glyma_ARKL2 | Glyma_ARKL2 | 370 |
| PfamB2828_Zinel_ARKL1 | Zinel_ARKL1 | 371 |
| PfamB2828_Lotja_ARKL1 | Lotja_ARKL1 | 372 |
| PfamB2828_Arath_ARKL1 | Arath_ARKL1 | 373 |
| PfamB2828_Arath_ARKL2 | Arath_ARKL2 | 374 |
| PfamB2828_Arath_ARKL3 | Arath_ARKL3 | 375 |
| PfamB2828_Arath_ARKL4 | Arath_ARKL4 | 376 |
| PfamB2828_Arath_ARKL5 | Arath_ARKL5 | 377 |
| PfamB2828_Arath_ARKL6 | Arath_ARKL6 | 378 |
| PfamB2828_Arath_ARKL7 | Arath_ARKL7 | 379 |
| PfamB2828_Arath_ARKL8 | Arath_ARKL8 | 380 |
| PfamB2828_Arath_ARKL9 | Arath_ARKL9 | 381 |
| PfamB2828_Arath_ARKL10 | Arath_ARKL10 | 382 |
| PfamB2828_Arath_ARKL11 | Arath_ARKL11 | 383 |
| PfamB2828_Arath_ARKL12 | Arath_ARKL12 | 384 |
| PfamB2828_Poptr_ARKL1 | Poptr_ARKL1 | 385 |
| PfamB2828_Poptr_ARKL2 | Poptr_ARKL2 | 386 |
| PfamB2828_Poptr_ARKL3 | Poptr_ARKL3 | 387 |
| PfamB2828_Poptr_ARKL4 | Poptr_ARKL4 | 388 |
| PfamB2828_Poptr_ARKL5 | Poptr_ARKL5 | 389 |
| PfamB2828_Poptr_ARKL6 | Poptr_ARKL6 | 390 |
| PfamB2828_Poptr_ARKL7 | Poptr_ARKL7 | 391 |
| PfamB2828_Poptr_ARKL8 | Poptr_ARKL8 | 392 |
| PfamB2828_Poptr_ARKL9 | Poptr_ARKL9 | 393 |
| PfamB2828_Poptr_ARKL10 | Poptr_ARKL10 | 394 |
| PfamB2828_Medtr_ARKL1 | Medtr_ARKL1 | 395 |
| PfamB2828_Medtr_ARKL2 | Medtr_ARKL2 | 396 |
| PfamB2828_Medtr_ARKL3 | Medtr_ARKL3 | 397 |
| PfamB2828_Medtr_ARKL4 | Medtr_ARKL4 | 398 |

The results of the Pfam search of the polypeptide sequence as represented by SEQ ID NO: 409 are presented in Table C3-1 (Trusted matches) and Table C2 (Matches to Pfam-B).

TABLE C3-1:

Trusted matches from a Pfam search using SEQ ID NO: 409 as query sequence. Trusted matches have a higher than the gathering threshold for the specific domain in Pfam. DUF221 is a Pfam-A domain with accession number PF02714.

| Domain | Start | End | Bits | Evalue | Alignment | Mode |
|---|---|---|---|---|---|---|
| DUF221 | 305 | 411 | 44.10 | 2.3e−12 | Align | fs |

TABLE C3-2

Matches to Pfam-B

| Domain | Start | End | Alignment |
|---|---|---|---|
| Pfam-B_1332 | 1 | 110 | Align |
| Pfam-B_4698 | 144 | 233 | Align |
| Pfam-B_131006 | 234 | 304 | Align |

Example 5

Subcellular Localisation Prediction of the Polypeptide Sequences Useful in Performing the Methods of the Invention Experimental methods for protein localization range from immunolocalization to tagging of proteins using green fluorescent protein (GFP) or beta-glucuronidase (GUS). For example, a GRF polypeptide fused to a GUS reporter gene was used to transform transiently onion epidermal cells (van der Knapp et al. (2000) Plant Phys 122: 695-704). The nucleus was identified as the subcellular compartment of the GRF polypeptide. Such methods to identify subcellular compartmentalisation of GRF polypeptides are well known in the art.

A predicted nuclear localisation signal (NLS) was found by multiple sequence alignment, followed by eye inspection, in the WRC domain (CRRTDGKKWRC) (found within SEQ ID NO: 116) of the GRF polypeptide of Table A. An NLS is one or more short sequences of positively charged lysines or arginines.

Computational prediction of protein localisation from sequence data was performed. Among algorithms well known to a person skilled in the art are available at the ExPASy Proteomics tools hosted by the Swiss Institute for Bioinformatics, for example, PSort, TargetP, ChloroP, Loc-Tree, Predotar, LipoP, MITOPROT, PATS, PTS1, SignalP and others.

LOCtree is an algorithm that can predict the subcellular localization and DNA-binding propensity of non-membrane proteins in non-plant and plant eukaryotes as well as prokaryotes. LOCtree classifies eukaryotic animal proteins into one of five subcellular classes, while plant proteins are classified into one of six classes and prokaryotic proteins are classified into one of three classes. Table D below shows the output of LOCtree using the polypeptide sequence information of SEQ ID NO: 2. High confidence predictions have reliability index values greater than 5.

TABLE D

Output of LOCtree using the polypeptide sequence information of SEQ ID NO: 2.

| Predicted Localization | Reliability index | Intermediate localization prediction (output of different SVMs in hierarchical tree) | Reliability index |
|---|---|---|---|
| DNA binding | 6 | Not secreted, Nuclear, DNA-binding | 8, 6, 9 |

The predicted subcellular compartment of the GRF polypeptide as represented by SEQ ID NO: 2 using the LOCTree algorithm is the nucleus.

Example 6

Assay Related to the Polypeptide Sequences Useful in Performing the Methods of the Invention GRF polypeptides useful in the methods of the present invention (at least in their native form) typically, but not necessarily, have transcriptional regulatory activity and capacity to interact with other proteins. DNA-binding activity and protein-protein interactions may readily be determined in vitro or in vivo using techniques well known in the art (for example in Current Protocols in Molecular Biology, Volumes 1 and 2, Ausubel et al. (1994), Current Protocols). GRF polypeptides are capable of transcriptional activation of reporter genes in yeast cells (Kim & Kende (2004) Proc Natl Acad Sci 101(36): 13374-13379). GRF polypeptides are also capable of interacting with GRF-interacting factor polypeptides (GIF1 to GIF3; also called SYT1 to SYT3) in vivo in yeast cells, using a yeast two-hybrid protein-protein interaction assay (Kim & Kende, supra). In vitro binding assays are also used to show that GRF polypeptides and GIF (also called SYT) polypeptides are interacting partners (Kim & Kende, supra). The experiments described in this publication are useful in characterizing GRF polypeptides, and are well known in the art.

Example 7

Topology Prediction of the Polypeptide Sequences Useful in Performing the Methods of the Invention TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal presequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 121 are presented Table E1. The "plant" organism group has been selected, no cutoffs defined, and the predicted length of the transit peptide requested. The subcellular localization of the polypeptide sequence as represented by SEQ ID NO: 121 is likely to be the cytoplasm, no transit peptide (SignalP) or nuclear localisation signal (PredictNLS) is predicted.

TABLE E1

TargetP 1.1 analysis of the polypeptide sequence as represented by SEQ ID NO: 121

| Length (AA) | 109 |
|---|---|
| Chloroplastic transit peptide | 0.098 |
| Mitochondrial transit peptide | 0.404 |
| Secretory pathway signal peptide | 0.025 |
| Other subcellular targeting | 0.450 |
| Predicted Location | / |
| Reliability class | 5 |
| Predicted transit peptide length | / |

Many other algorithms can be used to perform such analyses, including:

ChloroP 1.1 hosted on the server of the Technical University of Denmark;

Protein Prowler Subcellular Localisation Predictor version 1.2 hosted on the server of the Institute for Molecular Bioscience, University of Queensland, Brisbane, Australia;

PENCE Proteome Analyst PA-GOSUB 2.5 hosted on the server of the University of Alberta, Edmonton, Alberta, Canada;

TMHMM, hosted on the server of the Technical University of Denmark

The results of TargetP 1.1 analysis of the polypeptide sequence as represented by SEQ ID NO: 169 are presented Table E2. The "plant" organism group has been selected, no cutoffs defined, and the predicted length of the transit peptide requested. The subcellular localization of the polypeptide sequence as represented by SEQ ID NO: 169 may be the mitochondrion; however it should be noted that the reliability class is 5 (i.e. the lowest reliability class).

TABLE E2

TargetP 1.1 analysis of the polypeptide sequence as represented by SEQ ID NO: 169

| Length (AA) | 105 |
|---|---|
| Chloroplastic transit peptide | 0.025 |
| Mitochondrial transit peptide | 0.552 |
| Secretory pathway signal peptide | 0.009 |
| Other subcellular targeting | 0.416 |

TABLE E2-continued

TargetP 1.1 analysis of the polypeptide sequence as represented by SEQ ID NO: 169

| Predicted Location | mitochondrion |
|---|---|
| Reliability class | 5 |

Two transmembrane domains are identified by the TMHMM program, hosted on the server of the Center for Biological Sequence Analysis, Technical University of Denmark. The probability that the N-terminus is located inside is 0.997. Further details on the orientation are given in Table F:

TABLE F results of TMHMM 2.0

| Orientation | begin-end residue | |
|---|---|---|
| inside | 1 | 42 |
| TMhelix | 43 | 65 |
| outside | 66 | 74 |
| TMhelix | 75 | 92 |
| inside | 93 | 105 |

Many other algorithms can be used to perform such analyses, including:

ChloroP 1.1 hosted on the server of the Technical University of Denmark;

Protein Prowler Subcellular Localisation Predictor version 1.2 hosted on the server of the Institute for Molecular Bioscience, University of Queensland, Brisbane, Australia;

PENCE Proteome Analyst PA-GOSUB 2.5 hosted on the server of the University of Alberta, Edmonton, Alberta, Canada;

Example 8

Functional Assay for the ARKL Polypeptides

The ubiquitination assay is carried out essentially as described by Stone et al. 2005. GST labeled ARKL protein is incubated at 30 C and pH 7.5 with yeast E1, purifed E2 At UBCC8, and ubiquitin (Sigma). The reaction is stopped and analyzed by SDS-PAGE electrophoresis followed by western blotting using ubiquitin antibodies.

Zinc chelating experiments are done by incubating TPEN-treated bead bound GST-ARKL protein with ZnCl2.

Example 9

Transmembrane Topology Prediction of the Polypeptide Sequences Useful in Performing the Methods of the Invention TMHMM V 2.O algorithm (Krogh et al. 2001 J Mol Biol, 305, 567-580) was used to predict transmembrane helices in SEQ ID NO: 409.

As shown below there are 4 predicted transmembrane helices. The position of the amino acide residues for the helices is also indicated. The loops between the transmembrane helices are predicted to be located at the inside of the membrane for loops between residues 28-85 and 172-373 and outside for loop between residues 109-151.

\# Sequence Number of predicted TMHs: 4
\# Sequence Exp number of AAs in TMHs: 89.26923
\# Sequence Exp number, first 60 AAs: 22.14249
\# Sequence Total prob of N-in: 0.04519
\# Sequence POSSIBLE N-term signal sequence

| | start end (amino acid coordinate) | | |
|---|---|---|---|
| SequenceTMHMM2.0 | outside | 1 | 4 |
| SequenceTMHMM2.0 | TMhelix | 5 | 27 |
| SequenceTMHMM2.0 | inside | 28 | 85 |
| SequenceTMHMM2.0 | TMhelix | 86 | 108 |
| SequenceTMHMM2.0 | outside | 109 | 151 |
| SequenceTMHMM2.0 | TMhelix | 152 | 171 |
| SequenceTMHMM2.0 | inside | 172 | 373 |
| SequenceTMHMM2.0 | TMhelix | 374 | 396 |
| SequenceTMHMM2.0 | outside | 397 | 428 |

Example 10 a) Cloning of Nucleic Acid Sequence as Represented by SEQ ID NO: 1

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The *Arabidopsis thaliana* cDNA encoding the GRF polypeptide sequence as represented by SEQ ID NO: 2 was amplified by PCR using as template an *Arabidopsis* cDNA bank synthesized from mRNA extracted from mixed plant tissues. The following primers, which include the AttB sites for Gateway recombination, were used for PCR amplification:

1) Prm 10010 (SEQ ID NO: 118, sense):
5'-GGGGACAAGTTTGTACAAAAAAGCAGGCTTAAACAATGATGAGTCTA
AGTGGAAGTAG-3'

2) Prm 10011 (SEQ ID NO: 119, reverse, complementary):
5'-GGGGACCACTTTGTACAAGAAAGCTGGGTAGCTCTACTTAATTAGCT
ACCAG-3'

PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombined in vivo with the pDONR201 plasmid to produce, according to the Gateway terminology, an "entry clone". Plasmid pDONR201 was purchased from Invitrogen, as part of the Gateway® technology.

b) Cloning of the Nucleic Acid Sequence Coding for RAA1-Like Polypeptides Used in the Methods of the Invention The nucleic acid sequence used in the methods of the invention was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm09129 (SEQ ID NO: 122; sense, start codon in bold):

5' ggggacaagtttgtacaaaaaagcaggcttaaacaatgtcaggggtt tgggtg 3' and prm09988 (SEQ ID NO: 123; reverse, complementary):

5' ggggaccactttgtacaagaaagctgggttgtcgcataggtcaatttagg 3', which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", pRAA1-like. Plasmid pDONR201 was purchased from Invitrogen, as part of the Gateway® technology.

c) Gene Cloning of the Nucleic Acid Sequence Coding for SYR Polypeptides

DNA manipulation: unless otherwise stated, recombinant DNA techniques are performed according to standard protocols described in (Sambrook (2001) Molecular Cloning: a laboratory manual, 3rd Edition, Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The *Oryza sativa* SYR gene was amplified by PCR using as template an *Oryza sativa* seedling cDNA library (Invitrogen, Paisley, UK). After reverse transcription of RNA extracted from seedlings, the cDNAs were cloned into pCMV Sport 6.0. Average insert size of the bank was 1.5 kb and the original number of clones was of the order of $1.59 \times 10^7$ cfu. Original titer was determined to be $9.6 \times 10^5$ cfu/ml after first amplification of $6 \times 10^{11}$ cfu/ml. After plasmid extraction, 200 ng of template was used in a 50 µl PCR mix. Primers prm08170 (SEQ ID NO: 170; sense, start codon in bold, AttB1 site in italic:

5'-*ggggacaagtttgtacaaaaaagcaggcttaaaca*atg*gaaggtgta*

*ggtgctagg*-3')

and prm08171 (SEQ ID NO: 171; reverse, complementary, AttB2 site in italic:

5'-*ggggaccactttgtacaagaaagctgggt*caaaaacaaaaataaatt cccc-3'), which include the AttB sites for Gateway recombination, were used for PCR amplification. PCR was performed using Hifi Taq DNA polymerase in standard conditions. A PCR fragment of the correct size was amplified and purified also using standard methods. The first step of the Gateway procedure, the BP reaction, was then performed, during which the PCR fragment recombines in vivo with the pDONR201 plasmid to produce, according to the Gateway terminology, an "entry clone", pSYR. Plasmid pDONR201 was purchased from Invitrogen, as part of the Gateway® technology.

d) Cloning of the Nucleic Acid Sequence Coding for ARKL Polypeptides Used in the Methods of the Invention The nucleic acid sequence used in the methods of the invention was amplified by PCR using as template a custom-made *Oryza sativa* seedlings and panicles cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm04873(SEQ ID NO: 404; sense, start codon in bold):

5'-ggggacaagtttgtacaaaaaagcaggcttaaacaatggatgatcac atgggaaga-3' and prm04874 (SEQ ID NO: 405; reverse, complementary):

5'-ggggaccactttgtacaagaaagctgggttttggtttctgaagaagc acc-3', which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", pARKL. Plasmid pDONR201 was purchased from Invitrogen, as part of the Gateway® technology.

e) Cloning of the Nucleic Acid Coding for YTP Polypeptides Used in the Methods of the Invention The nucleic acid sequence used in the methods of the invention was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 546: sense, start codon in bold):

5'-ggggacaagtttgtacaaaaaagcaggcttaaacaatggacaccgcg tcgt-3' and (SEQ ID NO: 547; reverse, complementary):

5'-ggggaccactttgtacaagaaagctgggtcagcacttgcattagatg gat-3', which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", pENTR-YTP1. Plasmid pDONR201 was purchased from Invitrogen, as part of the Gateway® technology.

Example 11 a) Expression Vector Construction Using the Nucleic Acid Sequence as Represented by SEQ ID NO: 1

The entry clone comprising SEQ ID NO: 1 was subsequently used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 117) for constitutive expression was located upstream of this Gateway cassette.

Figure 4:
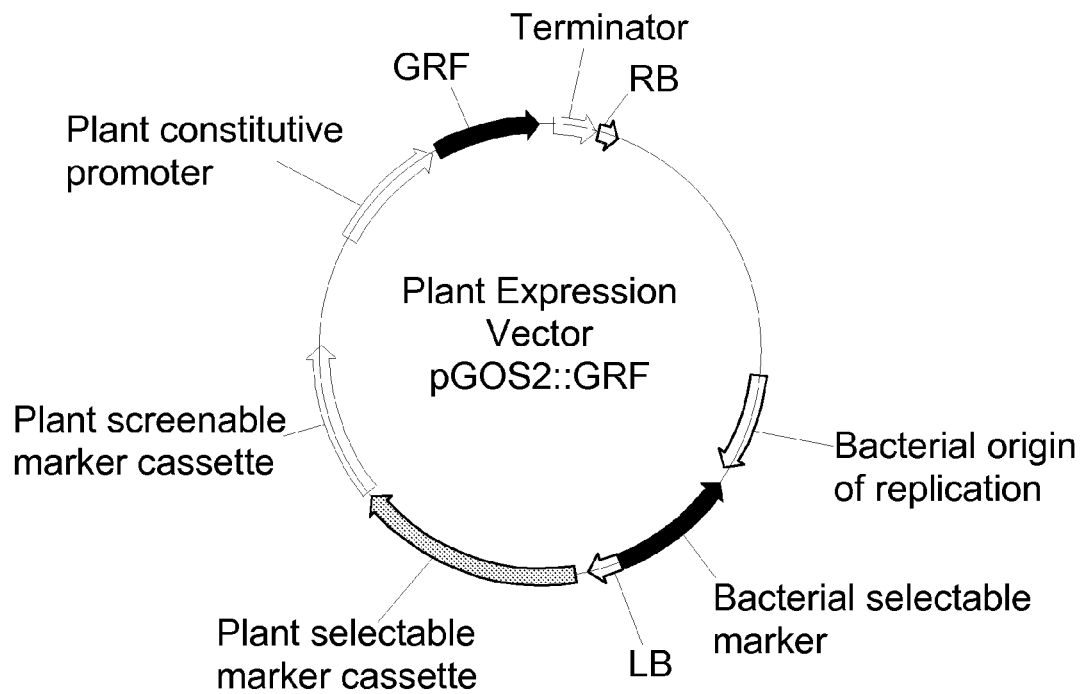
FIG. 4 shows the binary vector for increased expression in *Oryza sativa* of a nucleic acid sequence encoding a GRF polypeptide under the control of a GOS2 promoter (pGOS2) from rice.
Figure 8:
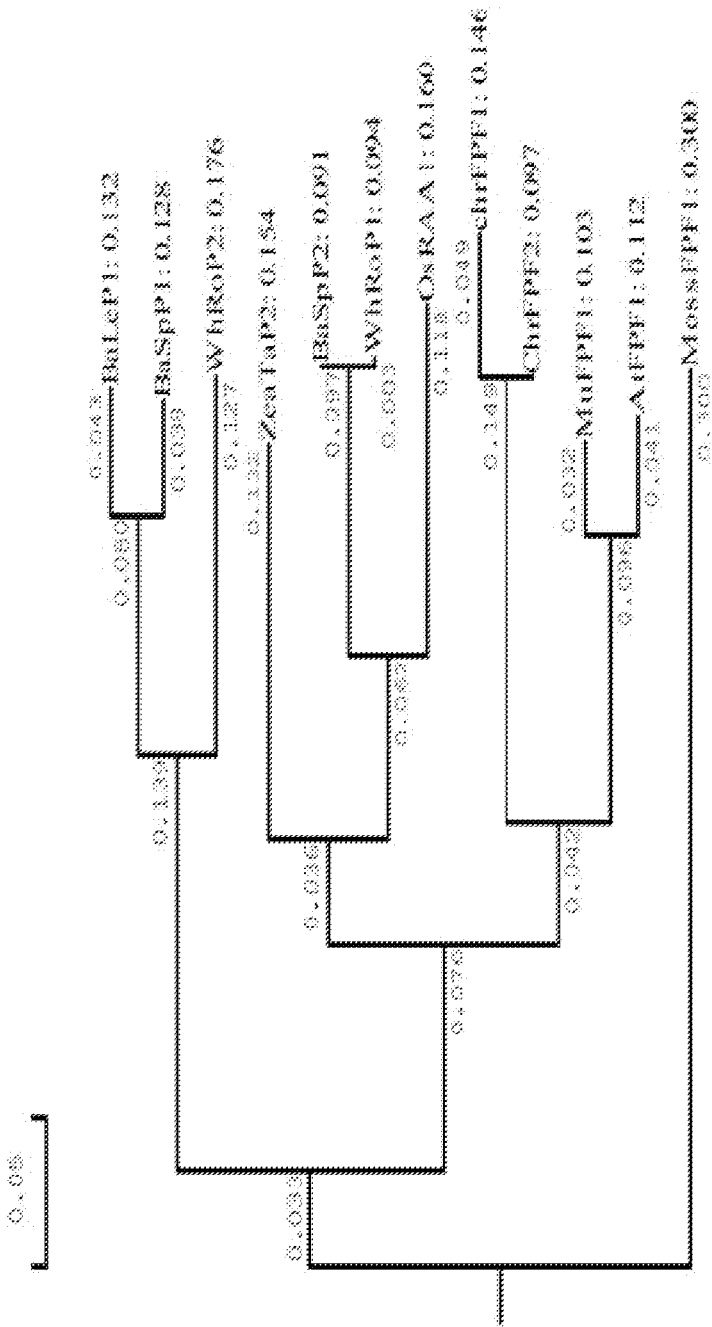
FIG. 8 shows a phylogenetic tree of RAA1-like polypeptides (Ge et al., 2004). OsRAA1 corresponds to SEQ ID NO: 121.

After the LR recombination step, the resulting expression vector pGOS2::GRF (FIG. 4) was transformed into *Agrobacterium* strain LBA4044 according to methods well known in the art.

b) Expression Vector Construction Using the Nucleic Acid Sequence as Represented by SEQ ID NO: 120

The entry clone comprising SEQ ID NO: 120 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 124) for constitutive expression was located upstream of this Gateway cassette. In an alternative embodiment, a rice HMGP promoter (SEQ ID NO: 125) for constitutive expression was located upstream of the Gateway cassette.

Figure 9:
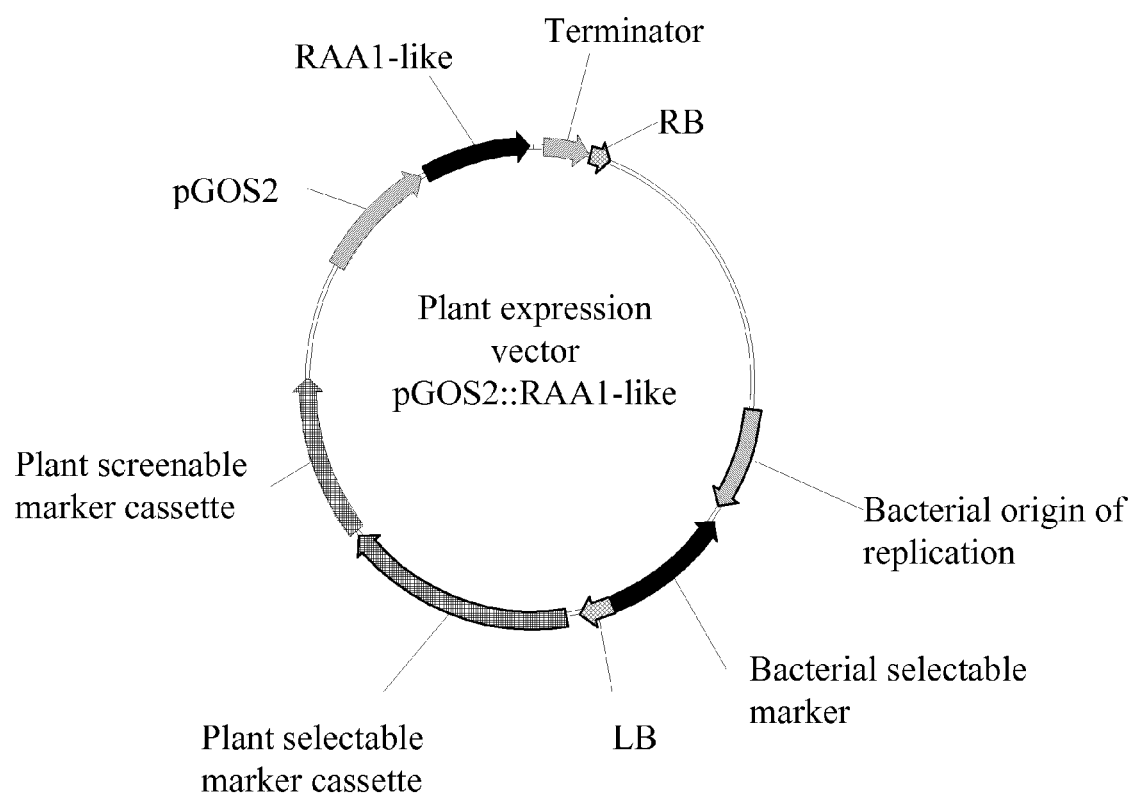
FIG. 9 represents the binary vector for increased expression in *Oryza sativa* of a RAA1-like-encoding nucleic acid under the control of a rice GOS2 promoter (pGOS2).

After the LR recombination step, the resulting expression vector pGOS2::RAA1-like (FIG. 9), or pHMGP::RAA1-like, was transformed into *Agrobacterium* strain LBA4044 according to methods well known in the art.

c) Expression Vector Construction Using the Nucleic Acid Sequence Coding for SYR Polypeptides The entry clone pSYR was subsequently used in an LR reaction with a destination vector used for *Oryza sativa* transformation. This vector contains as functional elements within the T-DNA borders: a plant selectable marker; a screenable marker expression cassette; and a Gateway cassette intended for LR in vivo recombination with the sequence of interest already cloned in the entry clone. A rice GOS2 promoter (SEQ ID NO: 211) for constitutive expression was located upstream of this Gateway cassette. A similar vector construct was prepared, but with the high mobility group protein promoter (HMGP, SEQ ID NO: 200 or SEQ ID NO: 210) instead of the GOS promoter.

Figure 13:
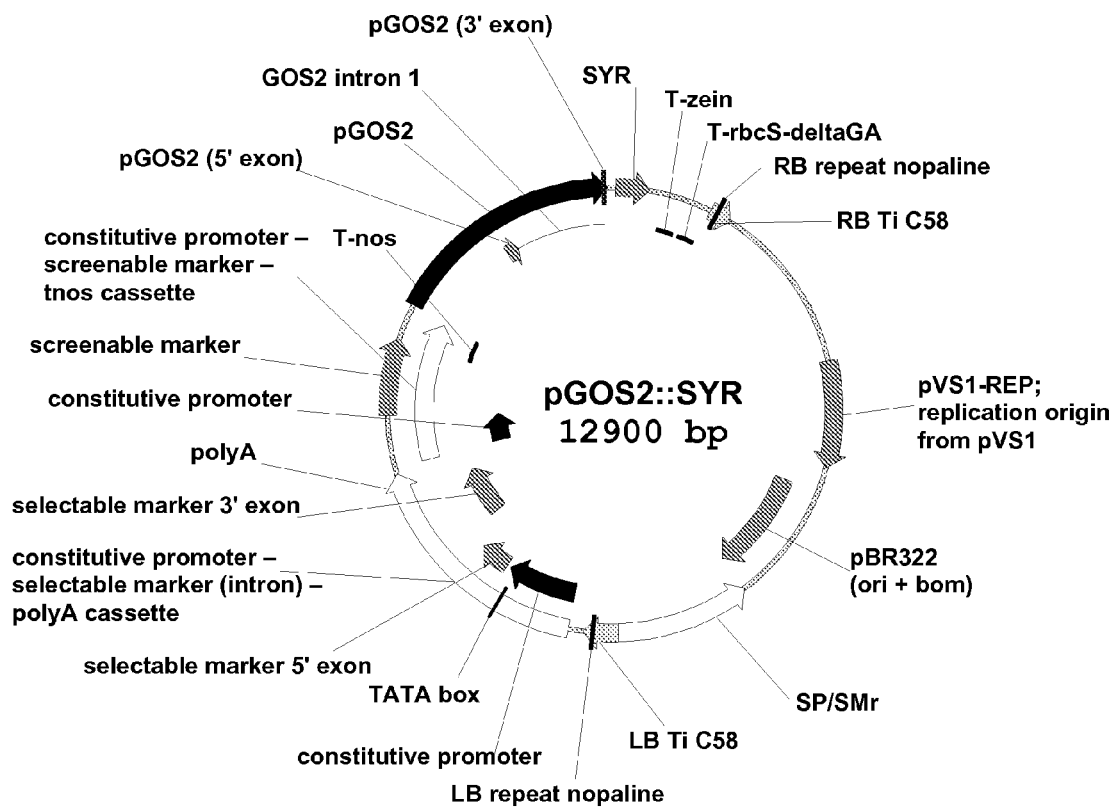
FIG. 13 shows binary vector pGOS2::SYR for transformation and expression in *Oryza sativa* of an *Oryza sativa* SYR nucleic acid under the control of a rice GOS2 promoter.

After the LR recombination step, the resulting expression vectors, pGOS2::SYR (with the GOS2 promoter) and pHMGP::SYR (with the HMGP promoter), both for constitutive SYR expression (FIG. 13) were transformed into *Agrobacterium* strain LBA4044 and subsequently to *Oryza sativa* plants.

d) Expression Vector Construction Using the Nucleic Acid Sequence as Represented by SEQ ID NO: 212

The entry clone comprising SEQ ID NO: 212 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 406) for root specific expression was located upstream of this Gateway cassette.

Figure 18:
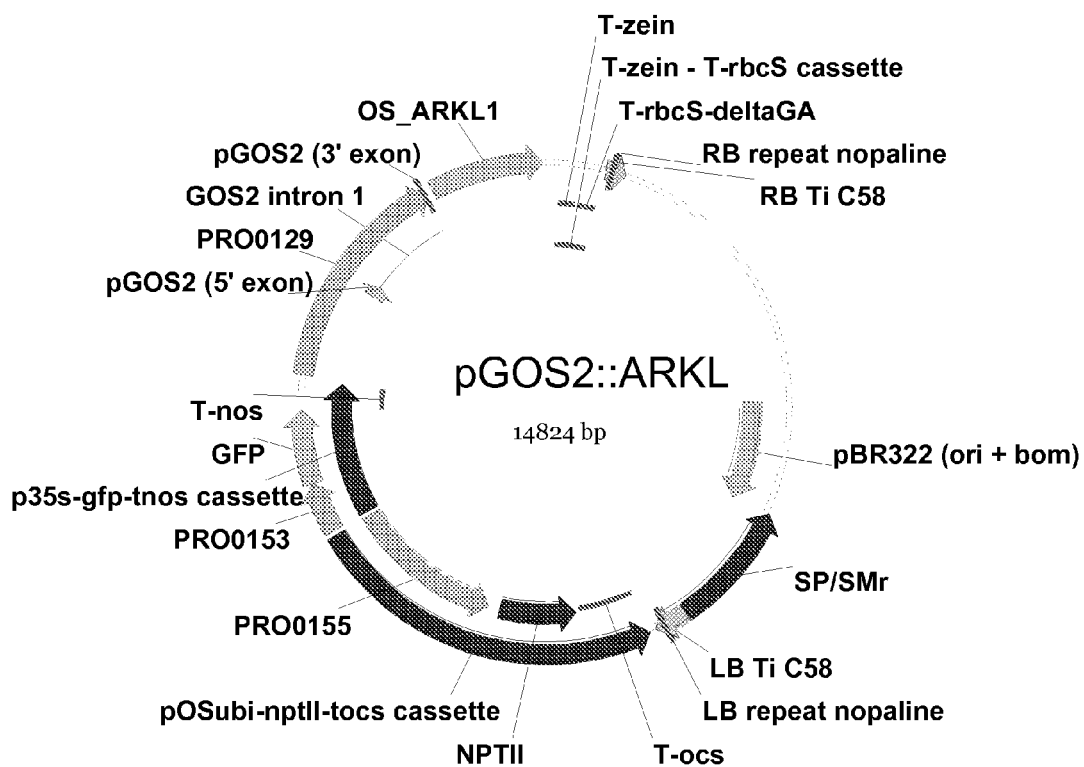
FIG. 18 represents the binary vector for increased expression of OS_ARKL1 nucleic acid as represented by SEQ ID NO: 212 under the control of a rice GOS2 promoter (pGOS2).

After the LR recombination step, the resulting expression vector pGOS2::ARKL (FIG. 18) was transformed into *Agrobacterium* strain LBA4044 according to methods well known in the art.

e) Expression Vector Construction Using the Nucleic Acid Sequence as Represented by SEQ ID NO: 408

The entry clone comprising SEQ ID NO: 408 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 548) for root specific expression was located upstream of this Gateway cassette.

After the LR recombination step, the resulting expression vector pGOS2::YTP1 (FIG. 23) was transformed into *Agrobacterium* strain LBA4044 according to methods well known in the art.

Example 12

Plant Transformation

Rice Transformation

The *Agrobacterium* containing the expression vector was used to transform *Oryza sativa* plants. Mature dry seeds of the rice *japonica* cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium).

After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing each individual expression vector was used independently for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for each construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges1996, Chan et al. 1993, Hiei et al. 1994).

Example 13

Phenotypic Evaluation Procedure 13.1-1 Evaluation Setup General

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%.

13.1-2 Evaluation Set-Up for Plants Transformed with SYR Under the Control of the Rice GOS2 Promoter or the HMGP Promoter Approximately 15 to 20 independent T0 rice transformants were generated. The primary transformants were transferred from a tissue culture chamber to a greenhouse for growing and harvest of T1 seed. Eight events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The selected T1 plants were transferred to a greenhouse. Each plant received a unique barcode label to link unambiguously the phenotyping data to the corresponding plant. The selected T1 plants were grown on soil in 10 cm diameter pots under the following environmental settings: photoperiod=11.5 h, daylight intensity=30,000 lux or more, daytime temperature=28° C. or higher, night time temperature=22° C., relative humidity=60-70%.

General Setup

From the stage of sowing until the stage of maturity the plants were passed several times through a digital imaging cabinet. At each time point digital images (2048×1536 pixels, 16 million colours) were taken of each plant from at least 6 different angles.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

13.2 Statistical Analysis: F-Test

A two factor ANOVA (analysis of variants) was used as a statistical model for the overall evaluation of plant phenotypic characteristics. An F-test was carried out on all the parameters measured of all the plants of all the events transformed with the gene of the present invention. The F-test was carried out to check for an effect of the gene over all the transformation events and to verify for an overall effect of the gene, also known as a global gene effect. The threshold for significance for a true global gene effect was set at a 5% probability level for the F-test. A significant F-test value points to a gene effect, meaning that it is not only the mere presence or position of the gene that is causing the differences in phenotype.

Because two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment-event-segregants). P values were obtained by comparing likelihood ratio test to chi square distributions.

Because two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment—event—segregants). P values were obtained by comparing likelihood ratio test to chi square distributions.

13.3 Parameters Measured

Biomass-Related Parameter Measurement (General Method)

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

Seed-Related Parameter Measurements (General Method)

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed weight per plant was measured by weighing all filled husks harvested from one plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed weight per plant and the above ground area (mm$^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Nitrogen Use Efficiency Screen (for Plants Transformed with SYR)

Rice plants from T2 seeds were grown in potting soil under normal conditions except for the nutrient solution. The pots were watered from transplantation to maturation with a specific nutrient solution containing reduced N nitrogen (N) content, usually between 7 to 8 times less. The rest of the cultivation (plant maturation, seed harvest) was the same as for plants not grown under abiotic stress. Growth and yield parameters are recorded as detailed for growth under normal conditions.

Drought Stress Screen (for Plants Transformed with SYR)

Rice plants from T1, T2 or further generations were grown in potting soil under normal conditions until they approached the heading stage. They were then transferred to a "dry" section where irrigation was withheld. Humidity probes were inserted in randomly chosen pots to monitor the soil water content (SWC). When SWC went below certain thresholds, the plants were automatically re-watered continuously until a normal level was reached again. The plants were then re-transferred again to normal conditions. The rest of the cultivation (plant maturation, seed harvest) was the same as for plants not grown under abiotic stress conditions. Growth and yield parameters were recorded as detailed for growth under normal conditions. The applied drought conditions were "severe drought conditions" as defined above.

Example 14

Results of the Phenotypic Evaluation of the Transgenic Rice Plants Expressing the Nucleic Acid Sequence Encoding a GRF Polypeptide as Represented by SEQ ID NO: 2

The results of the evaluation of transgenic rice plants expressing the nucleic acid sequence encoding a GRF polypeptide as represented by SEQ ID NO: 2, under the control of the GOS2 promoter for constitutive expression, and grown under normal growth conditions, are presented below.

There was a significant increase in the early vigor, in the aboveground biomass, in the total seed yield per plant, in the seed filling rate, in the harvest index, and in the thousand kernel weight (TKW) of the transgenic plants compared to corresponding nullizygotes (controls), as shown in Table G.

TABLE G

Results of the evaluation of transgenic rice plants expressing the nucleic acid sequence encoding a GRF polypeptide as represented by SEQ ID NO: 2, under the control of the GOS2 promoter for constitutive expression.

| Trait | Overall average % increase in 6 events in the T1 generation |
| --- | --- |
| Aboveground biomass | 2% |
| Early vigor | 13% |
| Total seed yield per plant | 12% |
| Seed filling rate | 5% |
| Harvest index | 11% |
| TKW | 11% |

Example 15 a) Results of the Phenotypic Evaluation of the Transgenic Rice Plants Expressing Nucleic Acid Sequences Encoding Other GRF Polypeptides Transgenic rice plants were generated, independently expressing the nucleic acid sequences encoding other GRF polypeptides, as shown in the Table H below, under the control of the GOS2 promoter for constitutive expression.

There was an increase in the Thousand Kernel Weight (TKW) of the seeds of transgenic plants compared to corresponding nullizygotes (controls), for the three constructs. This increase was less pronounced than for the seeds of transgenic plants expressing the nucleic acid sequence coding for the GRF polypeptide as represented by SEQ ID NO: 2.

TABLE H

Other GRF nucleic acid and polypeptide sequences tested in transgenic rice plants, under the control of the GOS2 promoter for constitutive expression.

| GRF polypeptide tested | Nucleic acid SEQ ID NO | Polypeptide SEQ ID NO |
| --- | --- | --- |
| AT4G37740 | SEQ ID NO: 15 | SEQ ID NO: 16 |
| AT2G36400 | SEQ ID NO: 7 | SEQ ID NO: 8 |
| AT2G22840 | SEQ ID NO: 5 | SEQ ID NO: 6 | b) Results of the Phenotypic Evaluation of the Transgenic Plants Expressing an RAM-like Nucleic Acid The results of the evaluation of transgenic rice plants expressing an RAA1-like nucleic acid under control of a constitutive promoter (whether GOS2 or HMGP) under non-stress conditions were as follows: an increase of at least 2% was observed for Thousand Kernel Weight and an increase of more than 5% was observed for at least one of the following parameters: root/shoot index, total root biomass, flowers per panicle. Also under conditions of reduced nitrogen availability, an increase was observed in one or more of: root biomass, height, and greenness index.

c1) Measurement of Yield-Related Parameters for pGOS2::SYR Transformants Grown Under Conditions of Nutrient Deficiency Upon analysis of the seeds as described above, the inventors found that plants transformed with the pGOS2::SYR gene construct and grown under nutrient deficiency stress, had a higher seed yield, expressed as number of filled seeds (increase of more than 5%), total weight of seeds (increase of more than 5%) and TKW (increase of more than 2.5%), compared to plants lacking the SYR transgene. There was also observed an increase in shoot biomass (more than 5%) and root biomass (several lines more than 5%).

c2) Measurement of Yield-Related Parameters for pGOS2::SYR Transformants Grown Under Conditions of Severe Drought Stress Upon analysis of the seeds as described above, the inventors found that plants transformed with the pGOS2::SYR gene construct and grown under severe drought stress, had a higher seed yield, expressed as total weight of seeds (increase of more than 5%), fill rate (increase of more than 5%) and Harvest Index (increase of more than 5%), compared to plants lacking the SYR transgene.

d) Results of the Phenotypic Evaluation of the Transgenic Plants Expressing the Orysa_ARKL1 Nucleic Acid The results of the evaluation of transgenic rice plants expressing the Orysa_ARKL1 nucleic acid under non-stress conditions are presented below. An increase of at least 5% was observed for emergence vigour (early vigour), total seed yield, number of filled seeds, thousand kernel weight and harvest index, and of 3% for thousand kernel weight.

TABLE I

Phenotypic evaluation results.

| Trait | % Increase in transgenic/control plants under non-stress conditions |
|---|---|
| Total seed yield | 11 |
| Number of filled seeds | 8 |
| TKW | 3 |
| Early vigour | 11 |
| Harvest index | 6 |

The transgenic rice plants expressing the Orysa_ARKL1 nucleic acid were also evaluated under drought stress conditions as described above. The same parameters (Increase in seed yield, number of filled seeds, early vigour and harvest index) were also increased in transgenic plants versus the corresponding control plant, though to a lower degree.

e) Results of the Phenotypic Evaluation of the Transgenic Plants Expressing an YTP1 Nucleic Acid The results of the evaluation of transgenic rice plants expressing an YTP1 nucleic acid under non-stress conditions are presented below. An increase of at least 5% was observed for total seed yield, seed filling rate, number of flowers per panicle, harvest index, and 2% for thousand kernel weight The results of the evaluation of transgenic rice plants expressing an YTP1 nucleic acid under non-stress conditions are presented hereunder. An increase was observed for total seed weight, number of filled seeds, fill rate, harvest index and thousand-kernel weight (Table J).

TABLE J

Phenotypic evaluation results.

| Yield related trait | % increase in the transgenic with respect to the control plants |
|---|---|
| Total seed weight | 10 |
| Seed filling rate | 6 |
| Flowers per panicle | 7 |
| Harvest index | 12 |
| Thousand kernel weight | 2 |

Example 16

Examples of Transformation of Other Crops

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M patent U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton (*Gossypium hirsutum* L.) transformation is performed using *Agrobacterium tumefaciens*, on hypocotyls explants. The commercial cultivars such as Coker 130 or Coker 312 (SeedCo, Lubbock, Tex.) are standard varieties used for transformation, but other varieties can also be used. The seeds are surface sterilized and germinated in the dark. Hypocotyl explants are cut from the germinated seedlings to lengths of about 1-1.5 centimeter. The hypotocyl explant is submersed in the *Agrobacterium tumefaciens* inoculum containing the expression vector, for 5 minutes then co-cultivated for about 48 hours on MS+1.8 mg/l KNO3+2% glucose at 24° C., in the dark. The explants are transferred the same medium containing appropriate bacterial and plant selectable markers (renewed several times), until embryogenic calli is seen. The calli are separated and subcultured until somatic embryos appear. Plantlets derived from the somatic embryos are matured on rooting medium until roots develop. The rooted shoots are transplanted to potting soil in the greenhouse. T1 seeds are produced from plants that exhibit tolerance to the selection agent and that contain a single copy of the T-DNA insert.

Example 17

Examples of Abiotic Stress Screens

Drought Screen

Plants from a selected number of events are grown in potting soil under normal conditions until they approached the heading stage. They are then transferred to a "dry" section where irrigation is withheld. Humidity probes are inserted in randomly chosen pots to monitor the soil water content (SWC). When SWC go below certain thresholds, the plants are automatically re-watered continuously until a normal level is reached again. The plants are then re-transferred to normal conditions. The rest of the cultivation (plant maturation, seed harvest) is the same as for plants not grown under abiotic stress conditions. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants were harvested. Growth and yield parameters are recorded as detailed for growth under normal conditions.

Reduced Nutrient (Nitrogen) Availability Screen

Plants from six events (T2 seeds) are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

SEQUENCE LISTING (556 sequences)

SEQ ID NO: 1 - DNA, 1194 bp, Arabidopsis thaliana
atgatgagtctaagtggaagtagcgggagaacaataggaaggcctccatttacaccaacacaatgggaagaactggaacatcaagccctaatctacaagtacatggtctctggtgttcctgtcccacctgagctcatcttctccattagaagaagcttggacacttccttggtctctagactccttcctcaccaatcccttggatgggggtgttaccagatgggatttgggagaaaaccagatccagagccaggaagatgcagaagaacagatggtaagaaatggagatgctcaagagaagcttacccagattcgaagtactgtgaaaaacacatgcacagaggaagaaaccgtgccagaaaatctcttgatcagaatcagacaacaacaactcctttaacatcaccatctctctcattcaccaacaacaacaacccaagtcccaccttgtcttcttcttcttcctctaattcctcttctactacttattctgcttcttcttcttcaatggatgcctacagtaacagtaataggtttgggcttggtggaagtagtagtaacactagaggttatttcaacagccattctcttgattatccttatccttctacttcacccaaacaacaacaacaaactcttcatcatgcttccgctttgtcacttcatcaaaatactaattctacttctcagttcaatgtcttagcctctgctactgaccacaaagacttcaggtactttcaagggattggggagagagttggaggagttggggagagaacgttctttccagaagcatctagaagctttcaagattctccataccatcatcaccaacaaccgttagcaacagtgatgaatgatccgtaccaccactgtagtactgatcataataagattgatcatcatcacacatactcatcctcatcatcatctcaacatcttcatcatgatcatgatcatagacagcaacagtgttttgttttgggcgccgacatgttcaacaaacctacaagaagtgtccttgcaaactcatcaagacaagatcaaaatcaagaagaagatgagaaagattcatcagagtcgtccaagaagtctctacatcacttctttggtgaggactgggcacagaacaagaacagttcagattcttggcttgacctttcttcccactcaagactcgacactggtagctaa

SEQ ID NO: 2 - protein, 397 aa, Arabidopsis thaliana
MMSLSGSSGRTIGRPPFTPTQWEELEHQALIYKYMVSGVPVPPELIFSIRRSLDTSLVSRLLPHQSLGWGCYQMGFGRKPDPEPGRCRRTDGKKWRCSREAYPDSKYCEKHMHRGRNRARKSLDQNQTTTTPLTSPSLSFTNNNNPSPTLSSSSSSNSSSTTYSASSSSMDAYSNSNRFGLGGSSSNTRGYFNSHSLDYPYPSTSPKQQQQTLHHASALSLHQNTNSTSQFNVLASATDHKDFRYFQGIGERVGGVGERTFFPEASRSFQDSPYHHHQQPLATVMNDPYHHCSTDHNKIDHHHTYSSSSSSQHLHHDHDHRQQQCFVLGADMFNKPTRSVLANSSRQDQNQEEDEKDSSESSKKSLHHFFGEDWAQNKNSSDSWLDLSSHSRLDTGS

SEQ ID NO: 3 - DNA, 735 bp, Arabidopsis thaliana
atggctacaaggattccattcacagaatcacaatgggaagaacttgaaaaccaagctcttgtgttcaagtacttagctgcaaatatgcctgttccacctcatcttctcttcctcatcaaaagaccctttctcttctcttcttcttcttcttcatcttcttcttcaagcttcttctctcccactctttctccacactttgggtggaatgtgtatgagatgggaatgggaagaaagatagatgcagagccaggaagatgtagaagaactgatggcaagaaatggagatgctctaaagaagcttaccctgactctaagtactgtgagagacatatgcatagaggcaagaaccgttcttcctcaagaaagcctcctcctactcaattcactccaaatctctttctcgactcttcttccagaagaagaagaagtggatacatggatgatttcttctccatagaaccttccgggtcaatcaaaagctgctctggctcagcaatggaagataatgatgatggctcatgtagaggcatcaacaacgaggagaagcagccggatcgacattgcttcatccttggtactgacttgaggacacgtgagaggccattgatgttagaggagaagctgaaacaaagagatcatgataatgaagaagagcaaggaagcaagaggttttataggtttcttgatgaatggccttcttctaaatcttctgtttctacttcactcttcatttga

SEQ ID NO: 4 - protein, 244 aa, Arabidopsis thaliana
MATRIPFTESQWEELENQALVFKYLAANMPVPPHLLFLIKRPFLFSSSSSSSSSSSFFSPTLSPHFGWNVYEMGMGRKIDAEPGRCRRTDGKKWRCSKEAYPDSKYCERHMHRGKNRSSSRKPPPTQFTPNLFLDSSSRRRRSGYMDDFFSIEPSGSIKSCSGSAMEDNDDGSCRGINNEEKQPDRHCFILGTDLRTRERPLMLEEKLKQRDHDNEEEQGSKRFYRFLDEWPSSKSSVSTSLFI

SEQ ID NO: 5 - DNA, 1593 bp, Arabidopsis thaliana
atggatcttggagttcgtgtttctggtcatgaaaccgtttcttctccgggtcaaactgaactcggatctggtttcagtaacaagcaagaaagatccggtttcgatggtgaagattgctggagaagttcaaagctctcacgaacatcaactgatggattctcttcttcccctgcctctgctaaaacgctgtcgtttcatcaaggcatccctttactgagatctaccactattaatgatcctcgtaaaggacaagaacacatgcttagcttctcttctgcttcaggcaaatcagatgtctcaccttatcttcagtactgtagaaactcaggatatggtttaggaggaatgatgaacacaagcaacatgcatggaaacttgttgacaggagtaaaaggacctttttcattgactcagtgggcagagctagagcaacaggcgttgatctataagtatatcacagccaatgtccctgttccatctagtttacttctctctctcaagaaatcttttttcccttatggttccttgcctcctaattcttttggatggggctcttttcatctgggcttttccggtggtaacatggatcccgagccagggagatgtcgccggacagatggaaagaaatggcggtgctcgagggacgctgttcccgatcaaaagtactgtgaacgacatattaacagaggccgccatcgttcaagaaagcctgtggaaggccaaaatggccacaatactaatgctgccgccgctgcttctgctgctgccgcttctaccgctgctgctgtgtccaaagcggcagcggggacttcagctgttgcgatgcgtggatcagataataacaatagccttgccgctgctgttggaacacaacatcataccaataatcaatctacagattctttggctaacagagttcaaaattctcgaggggcttcggtttttcctgccacgatgaacttacagtcgaaggaaactcatccgaaacaaagcaataatccctttgaattcggactcatctcttctgattcgttacttaatccgtcgcataaacaagcctcgtatgcaacctcttccaaaggctttggatcgtatcttgacttcggcaaccaagccaagcacgcggggaatcacaacaatgtcgattcttggcccgaagagctgaaatcggattggactcagctctcaatgtcaatccctatggctccatcttcccctgttcaagataaacttgcactctcacctttaaggttatcgcgtgagtttgaccccgcgatccacatgggattaggcgtcaacaccgagtttcttgaccccgggaaaaagacgaataactggataccaatctcctggggtaataacaactccatgggaggtccactcggcgaggtactaaacagcacgaccaatagtcccaagtttggttcctctccaacaggcgtcttgcaaaagtcgacatttggttctctttctaacagcagctcggcaagcagcaccatcattggcgataacaacaataagaacggtgatggaaaagatccgcttggcccgaccacgctgatgaatacttctgctactgctccttctctgtga

SEQ ID NO: 6 - protein, 530 aa, Arabidopsis thaliana
MDLGVRVSGHETVSSPGQTELGSGFSNKQERSGFDGEDCWRSSKLSRTSTDGFSSSPASAKTLSFHQGIPLLRSTTINDPRKGQEHMLSFSSASGKSDVSPYLQYCRNSGYGLGGMMNTSNMHGNLLTGVKGPFSLTQWAELEQQALIYKYITANVPVPSSLLLSLKKSFFPYGSLPPNSFGWGSFHLGFSGGNMDPEPGRCRRTDGKKWRCSRDAVPDQKYCERHINRGRHRSRKPVEGQNGHNTNAAAAASAAAASTAAAVSKAAAGTSAVAMRGSDNNNSLAAAVGTQHHTNNQSTDSLANRVQNSRGASVFPATMNLQSKETHPKQSNNPFEFGLISSDSLLNPSHKQASYATSSKGFGSYLDFGNQAKHAGNHNNVDSWPEELKSDWTQLSMSIPMAPSSPVQDKLALSPLRLSREFDPAIHMGLGVNTEFLDPGKKTNNWIPISWGNNNSMGGPLGEVLNSTTNSPKFGSSPTGVLQKSTFGSLSNSSSASSTIIGDNNNKNGDGKDPLGPTTLMNTSATAPSL

SEQ ID NO: 7 - DNA, 1197 bp, Arabidopsis thaliana
atggatttgcaactgaaacaatggagaagccagcagcagcaacaacatcagacagagtcagaagaacaaccttctgcagctaagataccaaaacatgtctttgaccagattcattctcacactgcaacttctactgctcttcctctctttacccctgagcctacttcttctaaactctcctctttgtctcctgattcttcctccaggttccccaagatggggagcttctttagctgggcacagtggcaagaacttgaactacaagctctgatctacaggtacatgttggctggtgctgctgttcctcaggagctccttttaccaatcaagaaaagccttctccatctatctccttcctactttcttcaccatcctcttcaacacctacctcattaccaacctgcttggtatttgggaagggcagcgatggatcctgagccaggcagatgcaggagaacggatggtaagaagtggagatgttcaagagacgtcttcgctggccacaagtattgcgagcgccacatgcaccgtggccgcaaccgttcaagaaagcctgtggaaactccaaccaccgtcaatgcaactgccacgtccatggcttcatcagtagcagccgcagccaccactacaacagcaacaacaacatctacgtttgcttttggtggtggtggtggtagtgaggaagtggttggtcaaggaggatctttcttcttctctggctcttctaactcttcatctgaacttctccaccttagtcaaagttgttcggagatgaagcaagaaagcaacaacatgaacaacaagaggccatacgagtcccacatcggattcagtaacaacagatcagatggaggacacatcctgaggcccttctttgacgattggcctcgttcttcgctccaagaagctgacaatagttcaagccccatgagctcagccacttgtctctccatctccatgcccgggaactcttcctcagacgtctctctgaagctgtccacaggcaacgaagagggagcccggagcaacaacaatgggagagatcagcaaaacatgagctggtggagcggtggaggttccaaccaccatcatcacaacatgggcggaccattggccgaagccctgagatcttcttcctcatcttccccaaccagtgttctccatcagcttggtgtctcgacacaagcctttcattga

SEQ ID NO: 8 - protein, 398 aa, Arabidopsis thaliana
MDLQLKQWRSQQQQQHQTESEEQPSAAKIPKHVFDQIHSHTATSTALPLFTPEPTSSKLSSLSPDSSSRFPKMGSFFSWAQWQELELQALIYRYMLAGAAVPQELLLPIKKSLLHLSPSYFLHHPLQHLPHYQPAWYLGRAAMDPEPGRCRRTDGKKWRCSRDVFAGHKYCERHMHRGRNRSRKPVETPTTVNATATSMASSVAAAATTTTATTTSTFAFGGGGGSEEVVGQGGSFFFSGSSNSSSELLHLSQSCSEMKQESNNMNNKRPYESHIGFSNNRSDGGHILRPFFDDWPRSSLQEADNSSSPMSSATCLSISMPGNSSSDVSLKLSTGNEEGARSNNNGRDQQNMSWWSGGGSNHHHHNMGGPLAEALRSSSSSSPTSVLHQLGVSTQAFH

SEQ ID NO: 9 - DNA, 1290 bp, Arabidopsis thaliana
atgcagagccctaaaatggagcaggaggaggttgaggaggagaggatgaggaataagtggccgtggatgaaggcggcgcagttaatggagtttcggatgcaagctttggtgtatagatacatagaggctggtctccgtgtgcctcatcatctcgtggtgcctatttggaacagtcttgctctctcttcttcctccaattacaactatcactcttcttctctgttgagtaacaagggagtaacccatatcgacacgttggaaactgaaccaactaggtgcaggagaacagatgggaagaaatggcgctgtagcaacacggtccttctattcgagaagtactgtgaacggcacatgcatagaggtcgtaaacgttcaagaaagcttgtggaatcttcttctgaggttgcttcatcatcaaccaaatacgacaacacttatggtttggataggtataacgagagtcagagtcatcttcatgggacaatctcgggttctagtaatgcgcaggtagttaccattgcttcactgcctagtgccagatcctgtgaaaatgtcattcgtccgtctttagtgatctctgaattcacaaacaaaagtgtgagtcacggcagaaagaacatggagatgagttatgatgactttattaatgaaaaagaggcgagtatgtgtgttggagttgttcctcttcaaggtgatgagagcaaaccttcggttcaaaagttcttccctgaggtatctgataaatgcttagaagctgcaaaattctcaagcaacaggaagaatgatataattgcaagaagcagagaatggaagaatatgaatgttaatggtggtttgtttcatggtatccacttttctccagacactgttcttcaagaacgtggttgttttcgtttacaaggagttgaaacagacaatgaaccaggaaggtgccgaagaacagatgggaagaagtggagatgcagcaaagatgttttgtctggtcagaagtactgcgataagcacatgcatagaggtatgaagaagaagcatccagttgatactactaactcacatgagaatgccgggtttagcccgttaaccgtggaaacagctgttagatcggttgtgccttgcaaagatggagatgaccagaagcattctgtttcagtcatgggaattacactgccccgagtttctgatgagaagagcactagcagttgcagtaccgacactaccattactgacacagctttaaggggtgaagacgacgatgaggagtacttgtctttgttttcaccaggtgtttag

SEQ ID NO: 10 - protein, 429 aa, Arabidopsis thaliana
MQSPKMEQEEVEEERMRNKWPWMKAAQLMEFRMQALVYRYIEAGLRVPHHLVVPIWNSLALSSSSNYNYHSSSLLSNKGVTHIDTLETEPTRCRRTDGKKWRCSNTVLLFEKYCERHMHRGRKRSRKLVESSSEVASSSTKYDNTYGLDRYNESQSHLHGTISGSSNAQVVTIASLPSARSCENVIRPSLVISEFTNKSVSHGRKNMEMSYDDFINEKEASMCVGVVPLQGDESKPSVQKFFPEVSDKCLEAAKFSSNRKNDIIARSREWKNMNVNGGLFHGIHFSPDTVLQERGCFRLQGVETDNEPGRCRRTDGKKWRCSKDVLSGQKYCDKHMHRGMKKKHPVDTTNSHENAGFSPLTVETAVRSVVPCKDGDDQKHSVSVMGITLPRVSDEKSTSSCSTDTTITDTALRGEDDDEEYLSLFSPGV

SEQ ID NO: 11 - DNA, 1647 bp, Arabidopsis thaliana
atggacttgcaactgaaacaatggagaagtcagcagcagaatgagtcagaagaacaaggctctgctgcaactaagatatcaaactttttctttgatcagattcagtcccaaactgctacttctgctgctgcggctcctcttcctctctttgtccctgaacccacttcttcctcttctttctcttgcttctctcctgactcttctaattcttcttcttcttccaggttcctcaagatgggaaacttcttcagctgggcacagtggcaagaacttgagctacaagcactgatctatagatacatgttggctggtgcttctgttcctcaagagcttctcttacctattaagaaaagtctcctccatcaatctcctatgcatttccttcaccatcctcttcaacatagttttcctcatcaccaaccttcttggtattggggaagaggagcaatggatcctgagccagggaggtgtaagagaactgacggcaagaaatggagatgttcaagggatgttgtagcgggccacaagtattgtgaccgccacattcaccgtggaagaaaccgttcaagaaagcctgtggaaaccgccacaaccaccatcacaacgacagccacaacaaccgcatcttcttttgtcttaggtgaggagcttggtcatggaccaaacaacaaccacttcttctcctctggttcatctcaacctctccaccttagtcatcaacaaagttgttcttcagagatgaaacaagaaagcaacaacaacaagaggccatatgaagctaacagtggattcagcaatggaagatcagacgatggtcacatcttgaggcatttctttgacgattggccacgatcatcagactctacctccagtccaatgagctcatccacttgtcatctttcaatctccatgcccggtaacaacacgtcctcagatgtttctctaaaactttccacaggcaatgaagaagaagaagagaacatgagaaataacaacaatgagagggagcaaatgaattggtggagcaatggagggaatcaccacaacaatatgggaggaccattagctgaggctttgaggtcagcttcttcgacgtcaagtgttcttcatcagatgggaatctctactcaagaaatgaagtatgtgaagccattgagcttattgggtaatgcgctgaagaccaaagtgtcagtccctggtcggtttctgggtttagatgttggtgataagtatgttggattagctatctcagatccttcaaatatggttgcttctccattgagtgttttgctcagaaagaaatcaaacattgacctgatggctacagatttccagaacctggtcaaagcattttctgtgtcgggattagtcgttggttatccatttggcaaactgaacaatgtagaggatgttgtcactgtgaatcttttcattgaggaacttcgtaagaccgaaaaactcaaggatgtgaaatacacatattgggacgagcgattatcatcaaagaccgttgaactgatgttgaagcccttgaatttgcatcctgttcaagagaagacaatgttggacaagttagccgcagtagttatacttcaggagtatttagattacgcgaacaggtatgtaaacactgagccagcagagtaa

SEQ ID NO: 12 - protein, 548 aa, Arabidopsis thaliana
MDLQLKQWRSQQQNESEEQGSAATKISNFFFDQIQSQTATSAAAAPLPLFVPEPTSSSSFSCFSPDSSNSSSSSRFLKMGNFFSWAQWQELELQALIYRYMLAGASVPQELLLPIKKSLLHQSPMHFLHHPLQHSFPHHQPSWYWGRGAMDPEPGRCKRTDGKKWRCSRDVVAGHKYCDRHIHRGRNRSRKPVETATTTITTTATTTASSFVLGEELGHGPNNNHFFSSGSSQPLHLSHQQSCSSEMKQESNNNKRPYEANSGFSNGRSDDGHILRHFFDDWPRSSDSTSSPMSSSTCHLSISMPGNNTSSDVSLKLSTGNEEEEENMRNNNNEREQMNWWSNGGNHHNNMGGPLAEALRSASSTSSVLHQMGISTQEMKYVKPLSLLGNALKTKVSVPGRFLGLDVGDKYVGLAISDPSNMVASPLSVLLRKKSNIDLMATDFQNLVKAFSVSGLVVGYPFGKLNNVEDVVTVNLFIEELRKTEKLKDVKYTYWDERLSSKTVELMLKPLNLHPVQEKTMLDKLAAVVILQEYLDYANRYVNTEPAE

SEQ ID NO: 13 - DNA, 1482 bp, Arabidopsis thaliana
atgaggatgcttcttgggattccttacgtagacaagtcggttctttccaactctgttcttgagagaggcaagcaggataaaagcaaactattgttagtcgacaaatgccattatgagcttgatgttgaagaacgcaaggaagattttgttggtgggtttggatttggtgttgtagaaaattcgcataaagacgttatggtgctacctcatcatcactattatccatcatattcatcaccttcctcttcttctttgtgttactgttctgctggtgttagcgatcccatgttctctgtttctagcaatcaggcttacacttcttctcacagtggtatgttcacacccgccggttctggttctgctgctgtgactgtagcagatccttttttctccttgagctcttcaggggaaatgagaagaagtatgaacgaagatgctggtgcagctttcagcgaagctcaatggcatgagcttgagaggcagaggaatatatacaagtacatgatggcttctgttcctgttcctccagagcttctcacaccctttcccaagaaccaccaatcaaacactaacccggatgtggatacatataggagtggaatgtttagtatttatgctgattacaagaatctgccgttgtctatgtggatgacagtaactgtggcagtggcgacaggaggctcattgcagctggggattgcttcaagcgcaagcaataacacggctgatctggagccatggaggtgcaagagaacagatgggaagaaatggaggtgctctagaaacgtgattcctgatcagaaatactgtgagagacacacacacaagagccgtcctcgttcaagaaagcatgtggaatcatctcaccaatcatctcaccacaatgacattcgtacggctaagaatgatactagccagcttgtgagaacttatcctcagttttacggacaacctataagccagatccctgtgctttctactcttccgtctgcctcctctccatatgatcaccacagaggactgaggtggtttacgaaagaagatgatgccattggaaccttaaacccggagactcaagaagctgtccagctgaaagttggatcaagcagagagctcaaacggggattcgattatgatctgaatttcaggcagaaagagccaatagtagaccagagctttggagcattgcagggtctattaagtctaaaccagacaccacaacataaccaagaaacaagacagtttgttgtagaaggaaagcaagatgaagcgatgggaagctctctgacactctcaatggctggaggaggcatggaggaaacagagggaacaaaccagcatcagtgggttagccatgaaggtccatcatggctctattcaacaacaccaggtggaccattggctgaagcactgtgtctcggtgtctccaacaacccaagttctagtactactactagtagctgcagcagaagctcaagctaa

SEQ ID NO: 14 - protein, 493 aa, Arabidopsis thaliana
MRMLLGIPYVDKSVLSNSVLERGKQDKSKLLLVDKCHYELDVEERKEDFVGGFGFGVVENSHKDVMVLPHHHYYPSYSSPSSSSLCYCSAGVSDPMFSVSSNQAYTSSHSGMFTPAGSGSAAVTVADPFFSLSSSGEMRRSMNEDAGAAFSEAQWHELERQRNIYKYMMASVPVPPELLTPFPKNHQSNTNPDVDTYRSGMFSIYADYKNLPLSMWMTVTVAVATGGSLQLGIASSASNNTADLEPWRCKRTDGKKWRCSRNVIPDQKYCERHTHKSRPRSRKHVESSHQSSHHNDIRTAKNDTSQLVRTYPQFYGQPISQIPVLSTLPSASSPYDHHRGLRWFTKEDDAIGTLNPETQEAVQLKVGSSRELKRGFDYDLNFRQKEPIVDQSFGALQGLLSLNQTPQHNQETRQFVVEGKQDEAMGSSLTLSMAGGGMEETEGTNQHQWVSHEGPSWLYSTTPGGPLAEALCLGVSNNPSSSTTTSSCSRSSS

SEQ ID NO: 15 - DNA, 1608 bp, Arabidopsis thaliana
atggatattggtgttcatgttcttgggtcggttactagtaatgaaaatgagtcacttggtctaaaagagcttataggaactaaacaagatagatccggattcatcggtgaggattgcttgcaacgaagcttgaagctagcaagaacgacaactagagcggaagaagaagaaaacttgtcttcttctgttgcagctgcttattgcaaaacgatgtcgtttcaccaaggcattcctctcatgagatctgcttctcctctttcctctgattctcgccgtcaagaacaaatgcttagcttctcagataaaccagacgctcttgatttcagtaaatatgtcggtttggataatagcagtaataacaagaactctctctcgccgtttcttcaccagattcctccaccttcttactttagaagctcaggaggatatggttctggtggaatgatgatgaacatgagcatgcaagggaacttcacaggtgttaaaggaccttttacattgactcaatgggctgagttagagcaacaggcgttgatctataagtacatcacagccaatgtccctgttccttctagtttgctcatctctatcaagaagtctttttatccttacggatctttgcctcctagttccttcggatggggaactttccatctcggtttcgcaggcggtaacatggaccctgagccagggagatgccgcagaacagatgggaagaaatggcggtgctcaagagacgccgttcctgatcagaaatactgtgaaagacacatcaacagaggccgtcatcgttcaagaaagcctgtggaagtccaatctggccaaaaccaaaccgccgctgctgcatccaaagcggttactacaccacaacagcctgttgtcgctggtaatactaacagaagcaatgcccgtgcatcaagcaaccgcagcctcgccattggaagtcaatatatcaatccttctacagaatctttacctaacaacagaggagtttcgatatatccttccaccgtcaacttacaacccaaggaatctccggttattcatcagaaacacagaaacaacaacaacccttttgagtttggacacatatcctctgattcgttactcaacccgaataccgcaaagacctatggatcatcgttcttggatttcagcagcaaccaagagaagcattcagggaatcacaatcacaattcttggcctgaagagctgacatcagattggacacagctctcaatgtcaattccaatagcatcatcatccccttcctccacacacaacaacaacaatgctcaagaaaaaacaacactctcgcctctcaggctatcccgcgagcttgacctatcgatccaaaccgatgaaacaacaatcgagcctactgtgaaaaaggtgaatacttggataccaatctcatggggaaactccttaggaggtcctctaggtgaagtactaaacagtacaacgaatagtccaacatttggatcttctcctacaggggttttgcaaaagtccacattttgttcactctctaacaacagctccgtgagcagccccattgcagagaacaacagacacaatggcgattactttcattacacaacctga

SEQ ID NO: 16 - protein, 535 aa, Arabidopsis thaliana
MDIGVHVLGSVTSNENESLGLKELIGTKQDRSGFIGEDCLQRSLKLARTTTRAEEEENLSSSVAAAYCKTMSFHQGIPLMRSASPLSSDSRRQEQMLSFSDKPDALDFSKYVGLDNSSNNKNSLSPFLHQIPPPSYFRSSGGYGSGGMMMNMSMQGNFTGVKGPFTLTQWAELEQQALIYKYITANVPVPSSLLISIKKSFYPYGSLPPSSFGWGTFHLGFAGGNMDPEPGRCRRTDGKKWRCSRDAVPDQKYCERHINRGRHRSRKPVEVQSGQNQTAAAASKAVTTPQQPVVAGNTNRSNARASSNRSLAIGSQYINPSTESLPNNRGVSIYPSTVNLQPKESPVIHQKHRNNNNPFEFGHISSDSLLNPNTAKTYGSSFLDFSSNQEKHSGNHNHNSWPEELTSDWTQLSMSIPIASSSPSSTHNNNNAQEKTTLSPLRLSRELDLSIQTDETTIEPTVKKVNTWIPISWGNSLGGPLGEVLNSTTNSPTFGSSPTGVLQKSTFCSLSNNSSVSSPIAENNRHNGDYFHYTT

SEQ ID NO: 17 - DNA, 1098 bp, Arabidopsis thaliana
atggactttctcaaagtttcagacaagacaacaattccatatagaagtgattctttgtttagtttgaatcagcaacaatacaaagagtcttcttttggattcagagacatggagattcatccgcatcctactccatatgcaggaaatggacttttgggttgttattactattaccctttcacaaacgcacaattgaaggagcttgagagacaagcaatgatctacaagtacatgatcgcatctattcctgttcctttcgatctacttgtttcttcaccatcctctgcctctccttgtaacaataaaaacatcgccggagatttagagccgggaagatgccggagaacagacggaaagaaatggagatgcgcgaaagaagtcgtctctaatcacaaatactgtgagaaacacttacacagaggtcgtcctcgttcaagaaagcatgtggaacctccttattctcgccctaacaacaatggtggttctgtgaaaaacagagatctcaaaaagcttcctcaaaagttatctagtagttccatcaaagacaaaacacttgagccaatggaggtttcatcatcaatctcaaactatagagactccagaggaagtgagaaatttactgtattggcaacaacagagcaagagaacaagtatctgaatttcatagatgtatggtccgatggagtaagatcatctgaaaaacagagtacaacttcaacacctgtttcttcttccaatggcaatctctctctttactcgcttgatctctcaatgggaggaaacaacttaatgggccaagacgaaatgggcctgatacaaatgggcttaggtgtaatcgggtcgggtagtgaggatcatcacgggtatggtccttatggtgtgacttcttcactagaggagatgtcaagctggcttgctccgatgtctaccacacctggtggaccattagcggagatactgaggccgagtacgaatttggcgatctctggtgatatcgaatcgtatagcttgatggagactcccactccaagctcgtccccgtctagagtgatgaagaagatgactagttcagtgtccgacgaaagcagccaggtttag

SEQ ID NO: 18 - protein, 365 aa, Arabidopsis thaliana
MDFLKVSDKTTIPYRSDSLFSLNQQQYKESSFGFRDMEIHPHPTPYAGNGLLGCYYYYPFTNAQLKELERQAMIYKYMIASIPVPFDLLVSSPSSASPCNNKNIAGDLEPGRCRRTDGKKWRCAKEVVSNHKYCEKHLHRGRPRSRKHVEPPYSRPNNNGGSVKNRDLKKLPQKLSSSSIKDKTLEPMEVSSSISNYRDSRGSEKFTVLATTEQENKYLNFIDVWSDGVRSSEKQSTTSTPVSSSNGNLSLYSLDLSMGGNNLMGQDEMGLIQMGLGVIGSGSEDHHGYGPYGVTSSLEEMSSWLAPMSTTPGGPLAEILRPSTNLAISGDIESYSLMETPTPSSSPSRVMKKMTSSVSDESSQV

SEQ ID NO: 19 - DNA, 1658 bp, Aquilegia formosa x Aquilegia pubescens
acttaaaagaccagtcttagctttcttcattaattcctactactgttctcagtgttgctctttgagtttatagatatttttcttacaatgatgatgagtgctagaaacagaaatcctttcactgtaactcaatggcaagaacttgaacatcaagctctcatttataagtatatggcttcaggaatgcctataccacctgatctcatcttccctattaagagaagtcttgattcttcaagattctttcctcatcaaccaatggattggggttgttttcagatgggttatggcaggaaagttgatccagaacctggaaggtgcagaagaacagatggaaagaagtggagatgctcaaaggaagcatacccagactcaaagtactgtgagagacacatgcacagaggcagaaaccgttcaagaaagcctgtggaagttaatactacatcaaattcctcattaccactttcatcttttacctctagaactccttctagtaccattacttcaaataccaacccttcttcttattccctttcttcatctctaacatctgacaaatctcagcaagaacatcatcacccttatcataacacccctcttcattcctttctcaatcctagtagaacttcttgttcttctcctagaactcataatattgatttctcacctcatagcaataacaatgccaatttggtattagactctgggtcttactctaactcttatgaagatcacagaaacaggtatgttcatggtctaaaagaagaggtagatgaaagagctttcttttcagaagcatcaggaacattaagaagtgtaccagaatcaactttgaaagatccatggcgtttaacaccattaagaatgagttcttcaactcataaccaaccaaaagatggaaatttttctgatttacaaagagggtattctcagtttcaactccaacataaacaacaacaacagcaacaagaagaagaacagcattgttttattttaggtactgatttcaaatctgacaggtttatgaaaactagtactactactactgagaaagaagaatcacaacaaccacttcgccatttctttgatgaatggccacctaagagtaaagattcttggttgggtttagaagaagatagatcagatcaaggttcacattcaacaactcaactttcaatatctattcctatgtcttctcatgagttctcagtttcaaattccagaacctaacaataagatgatggttgatttacttaaagtgggattattatggaaagattaatgacaacaaggagttgattcaaggttgggttcagtgtctttgtacttgtattgtctttatttaattgatgatgagaagtttaggtagagagtgctatgtgttatttttttttttgttatgtgtgtggagtgattgaaaagtgtgtctttaaacagtaagattcctgtcttgtgttttcttgatagctgttagaactttgtttgaatgactgatgaacaaatatttgggatttggggatttgtttgtatcaatattaggtgttttttctgtctttttggcttcttccatgattgccaaagaccatttgttcaacctaaaaatgataatgaagggggggccaatttgatatcatgagcttggttgtcagttaggaaag

SEQ ID NO: 20 - protein, 377 aa, Aquilegia formosa x Aquilegia pubescens
MMMSARNRNPFTVTQWQELEHQALIYKYMASGMPIPPDLIFPIKRSLDSSRFFPHQPMDWGCFQMGYGRKVDPEPGRCRRTDGKKWRCSKEAYPDSKYCERHMHRGRNRSRKPVEVNTTSNSSLPLSSFTSRTPSSTITSNTNPSSYSLSSSLTSDKSQQEHHHPYHNTPLHSFLNPSRTSCSSPRTHNIDFSPHSNNNANLVLDSGSYSNSYEDHRNRYVHGLKEEVDERAFFSEASGTLRSVPESTLKDPWRLTPLRMSSSTHNQPKDGNFSDLQRGYSQFQLQHKQQQQQQEEEQHCFILGTDFKSDRFMKTSTTTTEKEESQQPLRHFFDEWPPKSKDSWLGLEEDRSDQGSHSTTQLSISIPMSSHEFSVSN

SEQ ID NO: 21 - DNA, 1286 bp, Brassica napus
gaagaaagatgatgggtctaagtggaaatggtgggagaacaatagagaggcctccatttacaccaacacaatggcaagaactggagaatcaagccctaatttacaagtacatggtctcaggagttcctgtcccacctgagctcatcttctccattagaagaagcttggactcttccttggtctctagactcctccctcaccaatccattgggtggggatgctatcagatggggtttggtagaaaaccagatccagaaccaggaaggtgcagaagaacagatggtaagaaatggagatgctcaagagaagcataccctgattcaaagtactgtgaaaaacacatgcacagaggaaggaaccgtgccagaaaatctattgatcagaatcagacaactgctcctttaacatcaccatctctctctttccccaacaacaacaacccaagccctaccttgtcttcttcctcctctacttattcagctgcttcttcatctccttccattgatgcttacagtaatatcaataggcttggtgttggtagtagtaacagtagaggttacttcaacaaccattcccttgactatccttatcctttgtcctcacctaaacagcaacaacaacagcaacaaactcttagtcatgtttctgctttgtcacttcatcaaaacacatctacacctcagctcaatgtctttgcctctgcaactgaccacaaagacttcagatattttcaagggattggggagagagttggagttggggaaagaactttttttccagaagcttctagaagctttcaagattctccataccatcaccaacaaccgttagcaacggtagtggataatccgtacgactgtactactgatcataagtttgatcatcatcatacatactcatcatcatctcaacatcatcatcatgaccaagatcatcgacaacaacaacaatgttttgttttgggcgccgacatgttcaacaaacccacaagaactatcttggaaaacacatcgagacaagattatcttaatcaagaagaggaagagaaagattcatcggacacgaagaagtcccttcatcatttctttggtgaagagtggacacagaacaagaacagttcagattcttggcttgacctttcttcccagtcaagactcgacactggtagctgattgatgaggccagatagcatcagtgatgggtctgcaccaacacacacacaaacacgtttgaagggtcacatttcacatctatttccgtggaacattgagacagacaagacactg

SEQ ID NO: 22 - protein, 387 aa, Brassica napus
MMGLSGNGGRTIERPPFTPTQWQELENQALIYKYMVSGVPVPPELIFSIRRSLDSSLVSRLLPHQSIGWGCYQMGFGRKPDPEPGRCRRTDGKKWRCSREAYPDSKYCEKHMHRGRNRARKSIDQNQTTAPLTSPSLSFPNNNNPSPTLSSSSSTYSAASSSPSIDAYSNINRLGVGSSNSRGYFNNHSLDYPYPLSSPKQQQQQQQTLSHVSALSLHQNTSTPQLNVFASATDHKDFRYFQGIGERVGVGERTFFPEASRSFQDSPYHHQQPLATVVDNPYDCTTDHKFDHHHTYSSSSQHHHHDQDHRQQQQCFVLGADMFNKPTRTILENTSRQDYLNQEEEEKDSSDTKKSLHHFFGEEWTQNKNSSDSWLDLSSQSRLDTGS

SEQ ID NO: 23 - DNA, 1559 bp, Hordeum vulgare
gggcagccgcagccgcagccgcagcagaggagagagagagggagggagaagcatatatggcgatgccctttgcctccctgtcgccggcagccgaccaccaccgctcctcccccatcttccccttctgccgctcctcccctctctactcggtaggggaggaggcggcgcatcagcatcctcatcctcagcagcagcagcagcagcacgcgatgagcggcgcgcggtgggcggcgaggccggcgcccttcacggcggcgcagtacgaggagctggagcagcaggcgctcatctacaagtacctcgtcgccggcgtccccgtcccgcaggacctcctcctccccatccgccgcggcttcgagaccctcgcctcgcgcttctaccaccaccacgcccttgggtacgggtcctacttcgggaagaagctggatccggagccggggcggtgccggcggacggacggcaagaagtggcggtgctccaaggaggccgctcaggactccaagtactgcgagcgccacatgcaccgcggccgcaaccgttcaagaaagcctgtggaaacgcagctcgtcgccagctcccactcccagtcccagcagcacgccaccgccgccttccacaaccactcgccgtatccggcgatcgccactggcggtggctccttcgccctggggtctgctcagctgcacatggacactgctgcgccttacgcgacgaccgccggtgctgccggaaacaaagatttcaggtattctgcctatggagtgaggacgtcggcgatcgaggagcacaaccagttcatcaccgcggccatggacaccgccatggacaactactcgtggcgcctgatgccgtcccaggcctcggcattctcgctctccagctaccccatgctgggcacgctgagcgacctggaccagagcgcgatctgctcgctggccaagactgagagggagccactgtccttcttcggcggcggcggcgacttcgacgacgactcggctgcggtgaagcaggagaaccagacgctgcggcccttcttcgacgagtggcccaaggacagggactcgtggccggagctgcaagaccacgacgccaacaacaacagcaacgccttctcagccaccaagctgtccatctccatgccggtcaccagctccgacttctctggcaccaccgccggctcccgctcgcccaacggtatatactcccggtgaacggcgtcggccggcctgatctctgctgatttgccgtggtcacgacgggcgtcctcaaatcatcacagatgagcgaaccggccgacccgatcgaatgtgtctgtgagccgactgcagcttgcttgctcattttgtatggatcgtcgtgcagcaggaacgaaacactactcctttaatttcctttctttaatttcacaacgttttttctgggttttgccgtgtatcggccggaactgtactaccaagttttctatagcctcgatggtcatgcacgacatcgttgactgtttcccgcgcacttactgttgaaataatcttccatttttggcaaaaaaaaaaaaaaaa

SEQ ID NO: 24 - protein, 385 aa, Hordeum vulgare
MAMPFASLSPAADHHRSSPIFPFCRSSPLYSVGEEAAHQHPHPQQQQQQHAMSGARWAARPAPFTAAQYEELEQQALIYKYLVAGVPVPQDLLLPIRRGFETLASRFYHHHALGYGSYFGKKLDPEPGRCRRTDGKKWRCSKEAAQDSKYCERHMHRGRNRSRKPVETQLVASSHSQSQQHATAAFHNHSPYPAIATGGGSFALGSAQLHMDTAAPYATTAGAAGNKDFRYSAYGVRTSAIEEHNQFITAAMDTAMDNYSWRLMPSQASAFSLSSYPMLGTLSDLDQSAICSLAKTEREPLSFFGGGGDFDDDSAAVKQENQTLRPFFDEWPKDRDSWPELQDHDANNNSNAFSATKLSISMPVTSSDFSGTTAGSRSPNGIYSR

SEQ ID NO: 25 - DNA, 1521 bp, Lycopersicon esculentum
gatgataagaaacacacaaatgacttaactttgcaggtttcaccgcactcgacactgcaaaaaagatacatataaaaaaaaaggtccactcaactctctgcaaaaataaaaaaaattaaaaacttttgtccaagacttaactttctcttcagaaataaatttgccttcacattaatattttgttgttagtaacaaaaatcattctcaatcgaaacatggacttcaatatgaagcaatggagtaatcaacatgagtcagaaaatcaagaatcaccaacaaagttaccaagacttcttcttgacttccactctgtttcttctgattctgcttctgctgctgctctaccattgtttgtatctgaaccaacaacatcaacaacaacttgtaccaaattaatgtcagattcagcaaccactgtcaccaccaaatttccaaggattggaagtggtggtggttacttcagcttggctcaatggcaagaacttgaactacacagtttgatttttaggcattttgtagctggtgcccctgttccttctgaactacttcatcttgttaagaaaagtattattgcttctcctcctcctcctccttcatattactttgctcatccatatcaacagtatcctcattatcaacaagctttgatgcagtcagggtactggggtagagccgccatggatccagaaccaggaaggtgtaggaggactgatggcaagaaatggaggtgctcaagggatgtagtggctggccagaaatactgcgagcgccacgttcatcgtggccgcagccgttcaagaaagcctgtggaaattcccacacctgccaacaatggcagtaaaaacaacaacactgtttctcatcatcaagcctttggaaaaatgactggacatgctcatgctggtggtggtgctcctcagttttctctttcgggacattcaccttccactaatgcgccttttcatctcaatcaaaggccaattaagggtccaccacaagaagtacttcaaaaagatgtatctattggtgatggtaaatcatctagtggccaaatcctacgccatttcttcgacgattggcctagacaacaacttcaagaaggcgacaatgctgcaaccagcctgtccatttcgatgcccggtgtagggggtaacccctcgtcagacttctcgttgaagctttcaactgggaattactatgattcaggtactcaagttagtaatgttgaacggtctacatgggggacgagtcaccaccacgtagcctcaatgggtggtccacttgccgaggccttaaggtcatcaacaactaactcgtcccctactagcgtgttgcatcaattggcacgaggtagcgcgtccgaggccagctatattagcacttgatttctgcaagtgttcttgttaaatgtttttttcttttggactttattgttttttaacttggttgtgttgttgttcattgttctttattggtattgatatacctaactgtcacctgtacaaaaaaaaaaaaaaaaaa

SEQ ID NO: 26 - protein, 389 aa, Lycopersicon esculentum
MDFNMKQWSNQHESENQESPTKLPRLLLDFHSVSSDSASAAALPLFVSEPTTSTTTCTKLMSDSATTVTTKFPRIGSGGGYFSLAQWQELELHSLIFRHFVAGAPVPSELLHLVKKSIIASPPPPPSYYFAHPYQQYPHYQQALMQSGYWGRAAMDPEPGRCRRTDGKKWRCSRDVVAGQKYCERHVHRGRSRSRKPVEIPTPANNGSKNNNTVSHHQAFGKMTGHAHAGGGAPQFSLSGHSPSTNAPFHLNQRPIKGPPQEVLQKDVSIGDGKSSSGQILRHFFDDWPRQQLQEGDNAATSLSISMPGVGGNPSSDFSLKLSTGNYYDSGTQVSNVERSTWGTSHHHVASMGGPLAEALRSSTTNSSPTSVLHQLARGSASEASYIST

SEQ ID NO: 27 - DNA, 1100 bp, Medicago truncatula
atgatgagtgcaagttcaagaaataggtcacttttcacaccaaatcaatggcaagaacttgaacaacaagccctagtttttaaatacatggttactggaacacctattccaccagatctcatatactctattaagagaagtttagacacttcaatatcttcaagaatctttcctcatccaccaattgggtggggatgttttgaaatgggatttggcagaaaagtagacccagagccagggaggtgcagaagaacagatggcaagaaatggagatgctcaaaggaagcatatccagactcaaagtactgtgaaagacacatgcacagaggtagaaaccgttcaagaaagcctgtggaactagtagtttcttcttcaacaacaacaccaacaaataacacaaacacagcatcttcttacagcaacagaaacatctccttgaacaacaacagcagcagcataaactcaccttcttctttccctttctctacttcatccatggcttgtcatgatcagtcacaatctttttcacaatcctaccaaaactcttctttaaacccttactattactctcaatcaattacctctactaacccacttgatcattctcattttcaaactcaagatgctactactcatcacctctttttggactcaacatcttattctcaggatgacaaggactttaggtatgtacaagttcaaggaataagagatggtactgtggatgagagaactttctttccagaagctacaggttcatctaggagctgttatcatgattcatatcaacaacaactatcaatgaatccctttaagtcttactcaagctcacagtttcagaatatcaatgatgataattcaagacaacaacaagaacaacactgttttgttttaggcactgacatcaagtcaacaagaacaacaaacaaggacaaagaaagtgagacaactcagaaaccacttcatcatttctttggtgagtggacaccaaagaacacagattcctggctagatcttgcttctaactccagaattccaacaggttgattatcatttatcatcattcctatgtttttgttttttttttgttattattaata

SEQ ID NO: 28 - protein, 348 aa, Medicago truncatula
MMSASSRNRSLFTPNQWQELEQQALVFKYMVTGTPIPPDLIYSIKRSLDTSISSRIFPHPPIGWGCFEMGFGRKVDPEPGRCRRTDGKKWRCSKEAYPDSKYCERHMHRGRNRSRKPVELVVSSSTTTPTNNTNTASSYSNRNISLNNNSSSINSPSSFPFSTSSMACHDQSQSFSQSYQNSSLNPYYYSQSITSTNPLDHSHFQTQDATTHHLFLDSTSYSQDDKDFRYVQVQGIRDGTVDERTFFPEATGSSRSCYHDSYQQQLSMNPFKSYSSSQFQNINDDNSRQQQEQHCFVLGTDIKSTRTTNKDKESETTQKPLHHFFGEWTPKNTDSWLDLASNSRIPTG

SEQ ID NO: 29 - DNA, 1302 bp, Medicago truncatula
atgcatatgttgacaatggaagctaaacctcttcaacttgttccctcttcacacaacagcacaactggtggtggaccccagatgaagattgagaatggtgaagttgatgaagagaaaagggttgttgttggagtgaaggaagatatagaaaacaagcctttgatcacagaagctcaaaggcgtgaacttgatcatcaagtttttatttttaatcattttgcttataatcttcctcttccttattaccttttgcaatttccaagtaatatgtcagagtacagtcgtcgtgggtctgattatgtgactatggtggatcaagaaccacataggtgtagaagaactgacggaaagaaatggaggtgcggcaaggacacagtacctaatcagaagtattgtgaacgtcacatgcacagaggtcgaaatcgttcaagaaagcttgtggaaacatctcaacttaactctcctttgaaaacaaatcctagtggtggtggcaagtcacatgcaaaactagtcccaaacattaaatcttcagtttcaaatccaaaccctttgattattcatcacaatggcacattctcatacaatccgaggaccttctgcgttgtagatacttcttctgtttgtgatcggtcgagacatgtcatagattatggtgccactgcagtgacaacttcgggaagcacgacatccgtttctttggataacagagtttgtcctaacgtatgcaagcaagatgagcagatcaagaggtgtatcaccgacaacgtgggtattaaaagtggtcggaaaggaagcatatcttgtgaaagtattggcatctctactggaataggcttttccccaaagagtgttcttccagtttctggttgcaatgattcatacctcaacaacagaaacaatatattagaacctgaacccggtagatgccgaagaacagatggtaagaagtggcgatgcaagagtgcggttcttccaggtcagaagtattgtgcaacacatatgcatagaggtgctaaaaggcgttttacaaacctcgaatctcctcctcctgccaccactgttattcctaaaactactgatattagttcagctgttaccattgctcagttgcccgacccttcggctccaatcgacatccagaaagcgaattgttggtctccgagcactaagctttcaatgtcggttcaagaaagtgcgccctttgttgattgtaatgagaaaagtgttagcagcggtgacacggatggtactagtaccaccatcactgacaccatgaatgagtgtagctatctttctttctaa

SEQ ID NO: 30 - protein, 433 aa, Medicago truncatula
MHMLTMEAKPLQLVPSSHNSTTGGGPQMKIENGEVDEEKRVVVGVKEDIENKPLITEAQRRELDHQVFIFNHFAYNLPLPYYLLQFPSNMSEYSRRGSDYVTMVDQEPHRCRRTDGKKWRCGKDTVPNQKYCERHMHRGRNRSRKLVETSQLNSPLKTNPSGGGKSHAKLVPNIKSSVSNPNPLIIHHNGTFSYNPRTFCVVDTSSVCDRSRHVIDYGATAVTTSGSTTSVSLDNRVCPNVCKQDEQIKRCITDNVGIKSGRKGSISCESIGISTGIGFSPKSVLPVSGCNDSYLNNRNNILEPEPGRCRRTDGKKWRCKSAVLPGQKYCATHMHRGAKRRFTNLESPPPATTVIPKTTDISSAVTIAQLPDPSAPIDIQKANCWSPSTKLSMSVQESAPFVDCNEKSVSSGDTDGTSTTITDTMNECSYLSF

SEQ ID NO: 31 - DNA, 1185 bp, Oryza sativa
atggcgatgccgtatgcctccctgtctccggcggtggccgaccaccgctcgtccccggcagccgcgaccgcctccctcctccccttctgccgctccaccccgctctccgcgggcggtggtggcgtcgcgatgggggaggacgcgccgatgaccgcgaggtggccgccggcggcggcggcgaggctgccgccgttcaccgcggcgcagtacgaggagctggagcagcaggcgctcatatacaagtacctggtggcaggcgtgcccgtcccgccggatctcgtgctccccatccgccgcggactcgactccctcgccgcccgcttctacaaccatcccgcccttggatatggtccgtacttcggcaagaagctggacccagagccagggcggtgccggcgtacggacggcaagaaatggcggtgctcgaaggaggccgcgccggattccaagtactgcgagcgccacatgcaccgcggccgcaaccgttcaagaaagcctgtggaaacgcagctggtcgcccagtcccaaccgccctcatctgttgtcggttctgcggcggcgccccttgctgctgcctccaatggcagcagcttccaaaaccactctctttaccctgctattgccggcagcaatggcgggggcggggggaggaacatgcccagctcatttggctcggcgttgggttctcagctgcacatggataatgctgccccttatgcagctgttggtggtggaacaggcaaagatctcaggtatactgcttatggcacaagatctttggcggatgagcagagtcaactcattactgaagctatcaacacatctattgaaaatccatggcggctgctgccatctcagaactcgccatttcccctttcaagctattctcagctgggggcactaagtgaccttggtcagaacacccccagctcactttcaaaggttcagaggcagccactttcgttctttgggaacgactatgcggctgtcgattctgtgaagcaagagaaccagacgctgcgtcccttctttgatgagtggccaaagggaagggattcatggtcagacctcgctgatgagaatgctaatctttcgtcattctcaggcacccaactgtcgatctccataccaatggcatcctctgacttctcggcggccagttctcgatcaactaatggtgactga

SEQ ID NO: 32 - protein, 394 aa, Oryza sativa
MAMPYASLSPAVADHRSSPAAATASLLPFCRSTPLSAGGGGVAMGEDAPMTARWPPAAAARLPPFTAAQYEELEQQALIYKYLVAGVPVPPDLVLPIRRGLDSLAARFYNHPALGYGPYFGKKLDPEPGRCRRTDGKKWRCSKEAAPDSKYCERHMHRGRNRSRKPVETQLVAQSQPPSSVVGSAAAPLAAASNGSSFQNHSLYPAIAGSNGGGGGRNMPSSFGSALGSQLHMDNAAPYAAVGGGTGKDLRYTAYGTRSLADEQSQLITEAINTSIENPWRLLPSQNSPFPLSSYSQLGALSDLGQNTPSSLSKVQRQPLSFFGNDYAAVDSVKQENQTLRPFFDEWPKGRDSWSDLADENANLSSFSGTQLSISIPMASSDFSAASSRSTNGD

SEQ ID NO: 33 - DNA, 1194 bp, Oryza sativa
atgatgatgatgagcggtcgcccgagcggcggcgccggcggaggtcggtacccgttcacggcgtcgcagtggcaggagctggagcaccaggcgctcatctacaagtacatggcgtccgggactcccatcccctccgacctcatcctccccctccgccgcagcttcctcctcgactccgccctcgccacctccccttccctcgccttccctccccaaccttcactggggtggggttgctttggcatggggtttgggcggaaggcggaggacccggagccagggcgatgccggcgtacggacggcaagaagtggcggtgctccaaggaggcgtacccggactccaagtactgcgagaagcacatgcaccgtggcaagaaccgttcaagaaagcctgtggaaatgtccttggccacgccgccgccgccgtcctcctccgccacctccgccgcgtcgaacacctccgccggcgtcgcccccaccaccaccaccacctcctccccggcgccctcctacagccgcccggcgccgcacgacgcggcgccgtaccaggcgctctacggcgggccctacgccgcggccaccgcgcgcacccccgccgccgcggcgtaccacgcgcaggtgagcccgttccacctccagctcgacaccacccacccgcacccgccgccgtcctactactccatggaccacaaggagtacgcgtacgggcacgccaccaaggaggtgcacggcgagcacgccttcttctccgatggcaccgagagggagcaccaccacgccgccgccgggcacggccagtggcagttcaagcagctcggcatggagcccaagcagagcaccacgcctctcttcccgggcgccggctacggccacaccgcggcgtcgccgtacgccattgatctttcaaaagaggacgacgatgagaaagagaggcggcaacagcagcagcagcagcagcagcagcactgcttcctcctgggcgccgacctccgtctggagaagccggcgggccacgaccacgcggcggcggcgcagaaacctctccgccacttcttcgacgagtggccgcatgagaagaacagcaagggctcctggatggggctcgaaggcgagacgcagctgtccatgtccatccccatggccgccaacgacctcccgatcaccaccacctcccgctaccacaatgatgattaa

SEQ ID NO: 34 - protein, 397 aa, Oryza sativa
MMMMSGRPSGGAGGGRYPFTASQWQELEHQALIYKYMASGTPIPSDLILPLRRSFLLDSALATSPSLAFPPQPSLGWGCFGMGFGRKAEDPEPGRCRRTDGKKWRCSKEAYPDSKYCEKHMHRGKNRSRKPVEMSLATPPPPSSSATSAASNTSAGVAPTTTTTSSPAPSYSRPAPHDAAPYQALYGGPYAAATARTPAAAAYHAQVSPFHLQLDTTHPHPPPSYYSMDHKEYAYGHATKEVHGEHAFFSDGTEREHHHAAAGHGQWQFKQLGMEPKQSTTPLFPGAGYGHTAASPYAIDLSKEDDDEKERRQQQQQQQQQHCFLLGADLRLEKPAGHDHAAAAQKPLRHFFDEWPHEKNSKGSWMGLEGETQLSMSIPMAANDLPITTTSRYHNDD

SEQ ID NO: 35 - protein, 1371 aa, Oryza sativa
ATGCAGGGTGCAATGGCCAGGGTGAGGGGTCCCTTCACGCCGTCTCAGTGGATCGAGCTGGAGCACCAGGCGCTGATATACAAGTACTTGGCTGCGAATAGCCCTGTACCACACAGCCTCCTCATCCCCATCAGGAGGAGCCTCACATCGCCCTACTCACCTGCCTACTTTGGCTCAAGCACATTGGGATGGGGATCTTTCCAGCTGGGCTACTCCGGCAGCGCGGATCCGGAGCCCGGCCGGTGCCGCCGGACGGACGGCAAGAAATGGCGGTGCTCGAGGGATGCGGTCGCCGACCAGAAGTACTGTGAGCGACACATGAACCGGGGACGCCACCGTTCAAGAAAGCATGTGGAAGGCCAGCCTGGCCATGCCGCGAAAGCGATGCCCGCGGCGGTGGCAGCAGCCGCTGCCTCTGCTACCCAGCCTAGTGCTCCGGCCGCCCACAGTGGCGGAGCTGTTGCTGGCCTCGCTATCAACCATCAGCACCAGCAAATGAAGAACTACGCTGCCAACACTGCCAATCCTTGCTCTCTGCAATATAGCAGGGATCTGGCAAACAAGCATAATGAGAGTGAACAAGTGCAAGACTCAGACAGTCTCTCGATGCTGACTTCCATTAGCACGAGAAATACGGGCAGCCTGTTTCCGTTCTCAAAACAACATAATCCTTTTGAAGTGTCCAACTCAAGGCCAGATTTTGGCCTAGTATCACCTGATTCACTGATGAGTTCTCCTCATAGCTCCTTGGAGAACGTCAATTTGCTCACTTCGCAGAGTCTGAATGAACAACAGAGTTCAGTTTCCCTTCAACACTTTGTGGACTGGCCAAGGACACCTGCACAAGGAGCTCTCGCATGGCCTGATGCTGAAGACATGCAAGCTCAGAGAAGCCAGCTCTCAATATCTGCTCCAATGGCGTCTTCTGACCTGTCATCAGCCTCAACATCTCCCATCCATGAGAAGCTGATGTTGTCACCACTTAAACTGAGCCGTGAATATAGTCCTATTGGTCTCGGTTTTGCAGCAAATAGAGATGAGGTTAACCAGGGAGAAGCAAACTGGATGCCTATGTTCCGTGATTCTTTGATGGGCGGACCATTGGGAGAGGTTTTAACCAAGAATAACAACATGGAAGCAAGGAATTGCCTATCGGAGTCTCTGAATCTTTTAAATGATGGCTGGGATTCAAGCTCAGGGTTTGATTCATCCCCAGTTGGTGTTCTGCAGAAGACCACCTTTGGATCAGTATCCAGTAGCACCGGAAGCAGTCCTAGACTGGAGAATCATAGTGTTTATGATGGCAACAGTAACCTGCGGGATGATCTCGGTTCAGTTGTTGTAAATCATCCGAGCATCCGCCTGGTGTGA

SEQ ID NO: 36 - protein, 456 aa, Oryza sativa
MQGAMARVRGPFTPSQWIELEHQALIYKYLAANSPVPHSLLIPIRRSLTSPYSPAYFGSSTLGWGSFQLGYSGSADPEPGRCRRTDGKKWRCSRDAVADQKYCERHMNRGRHRSRKHVEGQPGHAAKAMPAAVAAAAASATQPSAPAAHSGGAVAGLAINHQHQQMKNYAANTANPCSLQYSRDLANKHNESEQVQDSDSLSMLTSISTRNTGSLFPFSKQHNPFEVSNSRPDFGLVSPDSLMSSPHSSLENVNLLTSQSLNEQQSSVSLQHFVDWPRTPAQGALAWPDAEDMQAQRSQLSISAPMASSDLSSASTSPIHEKLMLSPLKLSREYSPIGLGFAANRDEVNQGEANWMPMFRDSLMGGPLGEVLTKNNNMEARNCLSESLNLLNDGWDSSSGFDSSPVGVLQKTTFGSVSSSTGSSPRLENHSVYDGNSNLRDDLGSVVVNHPSIRLV

SEQ ID NO: 37 - DNA, 711 bp, Oryza sativa
atgttggccgagggaaggcaagtctacttgccgccgccgccgccgtccaagcttcctcgtctctccggcaccgatccaaccgacggcgtggtgacgatggcagcgccgtcgccgctggttcttgggctgggtctcggtctgggcggcagcggcagcgacagcagtgggagcgacgcggaagcgtctgcggccaccgtgcgggaggcgcggccgccgtcggcgctgacgttcatgcagcggcaggagctggagcagcaggtgctcatctaccgctacttcgccgccggcgcgcctgtgccggttcacctcgtgctgcccatatggaagagcatcgccgccgcctcctcgttcggcccgcaaagctttccctccctgacgggcctggggagcctgtgcttcgactacaggagcagcatggagccggagccggggcggtgccggcgcacggacggcaagaagtggcggtgctcgcgcgacgtggtgccggggcacaagtattgcgagcggcacgtccaccgtggccgcggccgttcaagaaagcctatggaagcctctgcagcagtcgctcccacatatctcccggtccggccggcactccacaccgtcgccaccctcgccaccagcgcgccatcgctgtcgcacctcggtttctcctccgccagcaaagtgctcctcgcccacaccaccaccggcaccacgcgcgctacttga

SEQ ID NO: 38 - protein, 236 aa, Oryza sativa
MLAEGRQVYLPPPPPSKLPRLSGTDPTDGVVTMAAPSPLVLGLGLGLGGSGSDSSGSDAEASAATVREARPPSALTFMQRQELEQQVLIYRYFAAGAPVPVHLVLPIWKSIAAASSFGPQSFPSLTGLGSLCFDYRSSMEPEPGRCRRTDGKKWRCSRDVVPGHKYCERHVHRGRGRSRKPMEASAAVAPTYLPVRPALHTVATLATSAPSLSHLGFSSASKVLLAHTTTGTTRAT

SEQ ID NO: 39 - DNA, 1164 bp, Oryza sativa
atggcgatgccctttgcctccctgtcgccggcagccgaccaccggccctccttcatcttccccttctgccgctcctcccctctctccgcggtcggggaggaggcgcagcagcacatgatgggcgcgaggtgggcggcggcggtggccaggccgccgcccttcacggcggcgcagtacgaggagctggagcagcaggcgctcatatacaagtacctcgtcgccggcgtgcccgtcccggcggatctcctcctccccatccgccgtggcctcgactcactcgcctcgcgcttctaccaccaccctgtccttggatacggttcctacttcggcaagaagctggacccggagcccggacggtgccggcgtacggacggcaagaagtggcggtgctccaaggaggccgcgccggactccaagtactgtgagcgacacatgcaccgcggccgcaaccgttcaagaaagcctgtggaagcgcagctcgtcgccccccactcgcagccccccgccacggcgccggccgccgccgtcacctccaccgccttccagaaccactcgctgtacccggcgattgctaatggcggcggcgccaacggaggcggtggtggtggtggcggtggcggcagcgcgcctggctcgttcgccttggggtctaatactcagctgcacatggacaatgctgcgtcttactcgactgttgctgctggtgccggaaacaaagatttcaggtattctgcttatggagtgagaccattggcagatgagcacagcccactcatcactggagctatggatacctctattgacaattcgtggtgcttgctgccttctcagacctccacattttcagtttcgagctaccctatgcttggaaatctgagtgagctggaccagaacaccatctgctcgctgccgaaggtggagagggagccattgtcattcttcgggagcgactatgtgaccgtcgactccgggaagcaggagaaccagacgctgcgcccctttttcgacgagtggccaaaggcaagggactcctggcctgatctagctgatgacaacagccttgccaccttctctgccactcagctctcgatctccattccaatggcaacctctgacttctcgaccaccagctcacgatcacacaacggtatatactcccgatga

SEQ ID NO: 40 - protein, 387 aa, Oryza sativa
MAMPFASLSPAADHRPSFIFPFCRSSPLSAVGEEAQQHMMGARWAAAVARPPPFTAAQYEELEQQALIYKYLVAGVPVPADLLLPIRRGLDSLASRFYHHPVLGYGSYFGKKLDPEPGRCRRTDGKKWRCSKEAAPDSKYCERHMHRGRNRSRKPVEAQLVAPHSQPPATAPAAAVTSTAFQNHSLYPAIANGGGANGGGGGGGGGGSAPGSFALGSNTQLHMDNAASYSTVAAGAGNKDFRYSAYGVRPLADEHSPLITGAMDTSIDNSWCLLPSQTSTFSVSSYPMLGNLSELDQNTICSLPKVEREPLSFFGSDYVTVDSGKQENQTLRPFFDEWPKARDSWPDLADDNSLATFSATQLSISIPMATSDFSTTSSRSHNGIYSR

SEQ ID NO: 41 - DNA, 1071 bp, Oryza sativa
atgctgagctcgtcgccctcggcggcggcgccggggataggagggtaccagccgcagcgcggggcggcggtcttcacggcggcgcagtgggcggagctggagcagcaggcgctcatttacaagtacctcgtcgccggtgtccccgtcccgggcgatctcctcctcccaatccgcccccactcctccgccgccgccacctactccttcgccaaccccgccgccgcgcccttctaccaccaccaccaccacccctctctgagctattatgcctactatggcaagaagcttgaccctgagccgtggcgttgccgccgcaccgacggcaagaagtggcggtgctccaaggaggcgcaccccgactccaagtactgcgagcgccacatgcaccgtggccgcaaccgttcaagaaagcctgtggaatccaagaccgctgcccctgcgccccagtcgcagccccagctgtccaatgtcacgaccgcgactcacgacaccgatgcgcctctcccgtcactcactgtgggtgctaaaacccacggtctgtcccttggtggtgctggctcgtcgcagttccatgtcgacgcaccatcgtacggcagcaagtactctcttggagctaaagctgatgtgggtgaactgagcttcttctcaggagcatcaggaaacaccaggggcttcaccattgattctccaacagatagctcatggcattcactgccttccagtgtacccccatacccgatgtcaaagccaagggactctggcctcctaccaggtgcctactcctactcccaccttgaaccttcacaggaacttggccaggtcaccatcgcctcgctgtcccaagagcaggagcgccgctcttttggtggtggagcgggggggatgctaggaaatgtgaagcacgagaaccagccgctgaggcctttcttcgatgagtggcctgggaggcgagactcgtggtcggagatggatgaggagaggtccaaccagacctccttctcgacaacccagctctcgatctccatcccgatgcccagatgtgggtcccctatcggtccgcgtctaccttga

SEQ ID NO: 42 - protein, 356 aa, Oryza sativa
MLSSSPSAAAPGIGGYQPQRGAAVFTAAQWAELEQQALIYKYLVAGVPVPGDLLLPIRPHSSAAATYSFANPAAAPFYHHHHHPSLSYYAYYGKKLDPEPWRCRRTDGKKWRCSKEAHPDSKYCERHMHRGRNRSRKPVESKTAAPAPQSQPQLSNVTTATHDTDAPLPSLTVGAKTHGLSLGGAGSSQFHVDAPSYGSKYSLGAKADVGELSFFSGASGNTRGFTIDSPTDSSWHSLPSSVPPYPMSKPRDSGLLPGAYSYSHLEPSQELGQVTIASLSQEQERRSFGGGAGGMLGNVKHENQPLRPFFDEWPGRRDSWSEMDEERSNQTSFSTTQLSISIPMPRCGSPIGPRLP

SEQ ID NO: 43 - DNA, 1230 bp, Oryza sativa
atgctgagctcttgtggtggccatggccatggaaatccaagaagcttgcaagaagaacaccatggcagatgtggtgagcagcaaggtggaggaggaggaggagggcaagagcaagagcaagatgggttcttggtgagagaggcaagggcatccccaccatctccatcttcttcatcatttcttggatccacaagctcttcttgttctggaggaggaggaggagggcagatgttgagcttctcctcccccaatggaacagcagggttgggcttgagctcaggaggaagcatgcagggggtcttggcaagggtcagggggccgttcaccccaacacagtggatggagctggagcaccaggcactgatctacaagcacattgctgcaaatgtttctgtcccttccagcttgctcctccccatcaggagaagcctccatccatggggatggggatcattccctcctggctgtgctgatgtagaacccagaagatgccgccgcacagacggcaagaagtggcggtgctccagagatgctgttggggatcagaagtattgtgagcgacacataaaccgtggtcgccatcgttcaagaaagcatgtggaaggccgaaaggcgacactcaccattgcagaaccatccacggttattgctgctggtgtatcatctcgcggccacactgtggctcggcagaagcaggtgaaaggctcagctgctactgtctctgatcctttctcgagacaatccaacaggaaatttctggagaaacagaacgttgtcgaccaattgtctcccatggattcatttgatttctcatccacacaatcttctccaaactatgacaatgtagcattgtcaccactgaagttgcaccatgatcatgatgaatcttacatcgggcatggagcaggcagttcatcagaaaaaggcagtatgatgtacgaaagtcggttaacagtctctaaggaaacacttgatgatggacctttaggtgaagttttcaaaagaaagaattgccaatcagcttctacagaaatcttaactgaaaaatggactgagaaccccaacttacattgcccatctggaatcctacaaatggctactaagttcaattcaatttccagcggcaacacagtaaatagtggtggcaccgcagtggagaatcttatcactgataatggatatcttactgcaagaatgatgaatcctcatattgtcccaacacttctctaa

SEQ ID NO: 44 - protein, 409 aa, Oryza sativa
MLSSCGGHGHGNPRSLQEEHHGRCGEQQGGGGGGGQEQEQDGFLVREARASPPSPSSSSFLGSTSSSCSGGGGGGQMLSFSSPNGTAGLGLSSGGSMQGVLARVRGPFTPTQWMELEHQALIYKHIAANVSVPSSLLLPIRRSLHPWGWGSFPPGCADVEPRRCRRTDGKKWRCSRDAVGDQKYCERHINRGRHRSRKHVEGRKATLTIAEPSTVIAAGVSSRGHTVARQKQVKGSAATVSDPFSRQSNRKFLEKQNVVDQLSPMDSFDFSSTQSSPNYDNVALSPLKLHHDHDESYIGHGAGSSSEKGSMMYESRLTVSKETLDDGPLGEVFKRKNCQSASTEILTEKWTENPNLHCPSGILQMATKFNSISSGNTVNSGGTAVENLITDNGYLTARMMNPHIVPTLL

SEQ ID NO: 45 - DNA, 1293 bp, Oryza sativa
atggcaatggcgacccctacgaccaacggcagcttccttcttggatcaggtggctatcccggtgcccagattctaagcttctcctcctcaggtcacagcggcaatgggttggattgtggaagctcagatgtggcaagaatgcagggggttttagcaagggttagggggccattcacaccaacacaatggatggagctggagcaccaggctctgatctacaagcacattgtggcgaatgcgccggtaccggccggcttgctcctccccatcaggagaagcctccatccaccagtgttcccacacttctcctctggtggcattcttggctccagctccttgggatgggggtcatttcagctgggctattctgggagtgctgactccgagcccgggagatgccgtcgaaccgatggcaagaaatggcggtgctcgagagacgcagttgtcgaccaaaagtactgcgagcggcacataaaccggggtcgccaccgttcaagaaagcatgtggaaggccaatctagccatgccgcaaaagcaacggttcccgccatagcacaaccacccattggtgcatctaatggcaaattgtcaggcagccatggtgtgtcaaatgagctcacgaaaaccttggctactaacaggatgatgttggataaagcaaatcttattgaacgctcccaggactacactaatcagcaacacaacatcctacagaacaacacaaaaggtgataattggtctgaagagatgtcctcacaagcagactatgcagtaatccctgctggctctctcatgaacacaccgcaatcggcgaatttaaatccaattccccagcaacaacgctgtaagcagtcactctttggcaaagggatacagcatgatgacattcagctgtcgatatccattcccgtggataactccgacttacccactaactacaacaaggctcaaatggaccatgtagtaggcggttcatcgaatggcggaaacaacacgcgagcaagttggataccgggctcctgggaagcgtccataggtggacctctgggtgagttcttcaccaacaccagcagcgcatcagacgacaaaggcaaaagccgccacccgccatctttgaacctcttagctgatggacatactacaagtccacagctgcaatcgcccaccggagtcctgcagatgactagcttcagttcagtgcccagcagcactgttagtagtcctgcaggcagcctctgcaatggcttgctcacttcaggcctggtgaatgcccagactgtccaaacactgtga

SEQ ID NO: 46 - protein, 430 aa, Oryza sativa
MAMATPTTNGSFLLGSGGYPGAQILSFSSSGHSGNGLDCGSSDVARMQGVLARVRGPFTPTQWMELEHQALIYKHIVANAPVPAGLLLPIRRSLHPPVFPHFSSGGILGSSSLGWGSFQLGYSGSADSEPGRCRRTDGKKWRCSRDAVVDQKYCERHINRGRHRSRKHVEGQSSHAAKATVPAIAQPPIGASNGKLSGSHGVSNELTKTLATNRMMLDKANLIERSQDYTNQQHNILQNNTKGDNWSEEMSSQADYAVIPAGSLMNTPQSANLNPIPQQQRCKQSLFGKGIQHDDIQLSISIPVDNSDLPTNYNKAQMDHVVGGSSNGGNNTRASWIPGSWEASIGGPLGEFFTNTSSASDDKGKSRHPPSLNLLADGHTTSPQLQSPTGVLQMTSFSSVPSSTVSSPAGSLCNGLLTSGLVNAQTVQTL

SEQ ID NO: 47 - DNA, 1281 bp, Oryza sativa
atgtttgctgacttctctgctgctgccatggagcttggagaggtgttgggcttgcaaggactcacagtgccatccaccaaggagggtgatctgagcctcatcaagagagctgctgctggtagcttcacccaggctgctgctgcatcatacccttccccctttcttgatgaacagaagatgctcagattcgccaaggctgctcacacattgccatcaggtttggattttgggagggaaaatgagcagaggttcttgttgtctaggaccaagaggcctttcactccctcacagtggatggagctggagcaccaggctctcatttacaagtatctcaatgcaaaggcccctataccttccagcctgctcatttcaatcagcaaaagcttcagatcatcagctaacagaatgagctggaggcctctctatcaaggcttcccaaatgcagactctgacccagaacctggaagatgccgtcgaacagatggcaagaaatggcggtgttcaaaggaggccatggccgaccacaagtattgtgagaggcacatcaacagaaaccgccaccgttcaagaaagcctgtggaaaaccaaagtagaaagactgtgaaagagacaccgtgtgctggctcattgccatcttctgtcgggcagggcagcttcaagaaggcaaaagttaatgaaatgaagccacgcagtatcagctattggacagatagtttgaacaggacaatggcgaacaaagagaaaggaaacaaagctgctgaagaaaacaatggcccactgctaaatttaacgaatcaacagccaacattgtccctgttctctcagttgaagcaacagaacaaaccggagaagttcaatacagcaggagacagtgaatcgatttcttcaaataccatgttgaagccttgggagagcagcaaccagcagaacaacaaaagcattcctttcaccaagatgcatgatcgtggatgccttcagtcagtccttcagaatttcagcttgcctaaggacgagaaaatggagtttcagaaaagcaaagattccaatgtcatgacagttccatcaactttctattcctcgccagaggacccacgcgtcagctgccatgcacctaatatggcacaaatgcaagaggatagcatctcaagttcttgggagatgcctcaaggtggacctctaggtgagatcttgacaaactccaaaaatcctgacgattcaatcatgaaaccagaagcaaggccatatggttggttactgaacctcgaggatcatgcaatgtga

SEQ ID NO: 48 - protein, 426 aa, Oryza sativa
MFADFSAAAMELGEVLGLQGLTVPSTKEGDLSLIKRAAAGSFTQAAAASYPSPFLDEQKMLRFAKAAHTLPSGLDFGRENEQRFLLSRTKRPFTPSQWMELEHQALIYKYLNAKAPIPSSLLISISKSFRSSANRMSWRPLYQGFPNADSDPEPGRCRRTDGKKWRCSKEAMADHKYCERHINRNRHRSRKPVENQSRKTVKETPCAGSLPSSVGQGSFKKAKVNEMKPRSISYWTDSLNRTMANKEKGNKAAEENNGPLLNLTNQQPTLSLFSQLKQQNKPEKFNTAGDSESISSNTMLKPWESSNQQNNKSIPFTKMHDRGCLQSVLQNFSLPKDEKMEFQKSKDSNVMTVPSTFYSSPEDPRVSCHAPNMAQMQEDSISSSWEMPQGGPLGEILTNSKNPDDSIMKPEARPYGWLLNLEDHAM

SEQ ID NO: 49 - DNA, 894 bp, Oryza sativa
gacaactcactgccccccatcttctttcttcattcctcttcccaccaagaaccccaaaccttacctccattgagttcgaaaccgaggagcgaggagttacaagccgagttgtcagaatggatgaggagaaggaagccgactcgccgcagccaccgtccaagctgcctcgcctctccggcgctgacccgaatgccggagtggtgaccatggcagcacccccgccgccggtgggtcttgggctggggcttggactcggcggcgacagccgcggcgagcgtgacgtggaagcgtcggcggcggcggcgcacaaggcgacggcgctgacgttcatgcagcagcaggagctggagcaccaggtgctcatctaccgctacttcgccgcgggcgcgcccgtgccggtgcacctcgtgctccccatctggaagagcgtcgcgtcctcctccttcggcccgcaccgcttcccttccctggcagtgatggggttggggaacctgtgcttcgactaccggagcagcatggagccggacccagggcggtgcaggcgcacggacggcaagaagtggcggtgctcgcgcgacgtggtgccggggcacaagtactgcgagcggcacgtccaccgcggacgcggccgttcaagaaagcctgtggaagcctccgcggccgccaccccggcgaacaacggcggcggcggtggcatcgtcttctcccccaccagcgtcctcctcgcccacggcaccgcgcgcgccacctgaccagtgaccagaccggcgcccgtttgtttgtttgtctcggcgcatgggaaaacccaaatccgcagggattatgtcatgtcctgtaactctttttttcctcgcaacttttgaagccaaaacaattctcaccgtgttcgatggc

SEQ ID NO: 50 - protein, 211 aa, Oryza sativa
MDEEKEADSPQPPSKLPRLSGADPNAGVVTMAAPPPPVGLGLGLGLGGDSRGERDVEASAAAAHKATALTFMQQQELEHQVLIYRYFAAGAPVPVHLVLPIWKSVASSSFGPHRFPSLAVMGLGNLCFDYRSSMEPDPGRCRRTDGKKWRCSRDVVPGHKYCERHVHRGRGRSRKPVEASAAATPANNGGGGGIVFSPTSVLLAHGTARAT

SEQ ID NO: 51 - DNA, 1149 bp, Oryza sativa
atgccctttgcctccctgtcgccggcagccgaccaccggccctccttcatcttccccttctgccgctcctcccctctctccgcggtcggggaggaggcgcagcagcacatgatgggcgcgaggtgggcggcggcggtggccaggccgccgcccttcacggcggcgcagtacgaggagctggagcagcaggcgctcatatacaagtacctcgtcgccggcgtgcccgtcccggcggatctcctcctccccatccgccgtggcctcgactcactcgcctcgcgcttctaccaccaccctgtccttggatacggttcctacttcggcaagaagctggacccggagcccggacggtgccggcgtacggacggcaagaagtggcggtgctccaaggaggccgcgccggactccaagtactgtgagcgacacatgcaccgcggccgcaaccgttcaagaaagcctgtggaagcgcagctcgtcgccccccactcgcagccccccgccacggcgccggccgccgccgtcacctccaccgccttccagaaccactcgctgtacccggcgattgctaatggcggcggcgccaacggaggcggtggtggtggtggcggtggcggcagcgcgcctggctcgttcgccttggggtctaatactcagctgcacatggacaatgctgcgtcttactcgactgttgctgctggtgccggaaacaaagatttcaggtattctgcttatggagtgagaccattggcagatgagcacagcccactcatcactggagctatggatacctctattgacaattcgtggtgcttgctgccttctcagacctccacattttcagtttcgagctaccctatgcttggaaatctgagtgagctggaccagaacaccatctgctcgctgccgaaggtggagagggagccattgtcattcttcgggagcgactatgtgaccgtcgactccgggaagcaggagaaccagacgctgcgcccctttttcgacgagtggccaaaggcaagggactcctggcctgatctagctgatgacaacagccttgccaccttctctgccactcagctctcgatctccattccaatggcaacctctgacttctcgaccaccagctcacgatcacacaacgatgagtga

SEQ ID NO: 52 - protein, 382 aa, Oryza sativa
MPFASLSPAADHRPSFIFPFCRSSPLSAVGEEAQQHMMGARWAAAVARPPPFTAAQYEELEQQALIYKYLVAGVPVPADLLLPIRRGLDSLASRFYHHPVLGYGSYFGKKLDPEPGRCRRTDGKKWRCSKEAAPDSKYCERHMHRGRNRSRKPVEAQLVAPHSQPPATAPAAAVTSTAFQNHSLYPAIANGGGANGGGGGGGGGGSAPGSFALGSNTQLHMDNAASYSTVAAGAGNKDFRYSAYGVRPLADEHSPLITGAMDTSIDNSWCLLPSQTSTFSVSSYPMLGNLSELDQNTICSLPKVEREPLSFFGSDYVTVDSGKQENQTLRPFFDEWPKARDSWPDLADDNSLATFSATQLSISIPMATSDFSTTSSRSHNDE

SEQ ID NO: 53 - DNA, 1416 bp, Oryza sativa
gagagctccgtatcaccggcctctttcccttcccttcccctccgatccaatccccccttctcctcctcgcggcgctcgctgagcatggcggcggagggggaggccaagaaggacagcgccagcaaccctcccgggggaggaggcggcggaggtggaggggaggaggaggaggatagcagcctggctgtcggggaggcggcggtcggggtgggcgaggctggtggaggaggaggaggaggggagaaggcggatcgagaggaggaggaggggaaggaggatgtggaggagggcggcgtgtgtaaggatctggtgctcgtcgaggacgccgtccccgtcgaggatccggaggaagccgcagcaactgcagcacttcaggaagaaatgaaagcgctcgttgaatccgtcccagttggtgctggggcggcattcaccgcgatgcaactacaggagcttgagcagcaatctcgtgtctaccagtatatggctgcccgtgtgcctgtgcctactcatctcgtcttcccaatatggaagagtgttactggtgcatcttctgaaggcgcccagaagtacccgacattgatggggttggcaacactctgcttggactttggaaagaacccagaaccagaacctgggaggtgccggcgaactgatggaaagaagtggcggtgctggagaaatgcaattgcaaatgagaaatattgcgaacgccatatgcaccgtggccgcaagcgtcctgtacagcttgttgtcgaggatgacgagcctgattctacctcagggtcgaaaccagcatctggcaaggccaccgaaggtggcaagaagactgatgacaagagctcaagtagcaagaagcttgcagtggcagcaccagctgctgtggagtctacatgattgatgcagcatttaggagctgcataaagagcataactgtgctggcaattagagttcgcttcttattgtaatcctgaaaagactgtagtctggtctagctataacctcatcaagcaagaaaagtgtctgtggaaagaagccacaaaaactttcatttagctgtcactgaaattttcagtttaggtgtatagtttgatttagctttgccgtgccctctgccttcaggcagatgagcggcattattggataaatcctctctgactgacaatatcgcattgtgactcaagaagccgatggaaggatctgcgagactagatacgaagctatttgttgtgtatcattttatatggcctgcacaattgtgtgattttgtcagttgcataacatgtggaagatccataattttatgcactatggagattcaattaccttcctgaatgtctgagcttcgacatgttattggttattgtaacttaaaagcaacctgagattcaatgtgaaagggttttagattccagcttc

SEQ ID NO: 54 - protein, 269 aa, Oryza sativa
MAAEGEAKKDSASNPPGGGGGGGGGEEEEDSSLAVGEAAVGVGEAGGGGGGGEKADREEEEGKEDVEEGGVCKDLVLVEDAVPVEDPEEAAATAALQEEMKALVESVPVGAGAAFTAMQLQELEQQSRVYQYMAARVPVPTHLVFPIWKSVTGASSEGAQKYPTLMGLATLCLDFGKNPEPEPGRCRRTDGKKWRCWRNAIANEKYCERHMHRGRKRPVQLVVEDDEPDSTSGSKPASGKATEGGKKTDDKSSSSKKLAVAAPAAVEST

SEQ ID NO: 55 - DNA, 1854 bp, Populus tremuloides
tagtgaagctccttctcatgtctcacctcctgagaccaaaccaaagattcttggatctgtgttaagtaagcgagaaagatcagcttcgtctgctcaagatgattactggaggacttcaaagatgccaaaaaatgatgatttttctgtcaccaaaacaatgtcgttgcaccaacccacttctttactgagatctaattacatgctttctgatgattctcgccaacaagagcacatgatgagcttctcttctccaagaccagaaacgactccatttctaagcaaagatggtgagttagtggagagaagcacacaaaaccacactgccttaagctttcgttaccatcagaacacagcttcttcttatattagaagtgcaggttatgacaccggaggcttgaatgcaggcatgcacgggcctcttactggggttagaggaccatttactccatctcagtggatggagcttgaacatcaggccttgatctacaaatacatcactgctcgtgtgcctgtgccttctaatttgatcattcctctcaagaagtctgtctacccttatagcttacctggctcctctactggatccttccctcacaattcattgggatggagcgctttccatcttggttaccctggcaacaacactgatccggagcctggaaggtgtcgtcggactgatgggaagaaatggcggtgctcaagggatgctgtagctgaccaaaagtattgtgaaaggcacataaacagaggccgccatcgttcaagaaagcctgtggaaggccagactggccatgctgccactgggactgccagttcaaaggtggtgccaatgtcgaactcgatgtcaaaattggcaataaccagtggtggtgcctccaacagcattgcgatgaccacgcaacaacagttcaaaattttgcagccggctgctgccaacacttctgcagatgttgatgtcaacagagcacaagatgcacagagcatttctatgatgtcttccaccatcaaccggaaatctgatgagtcctctttctttgttcctaaacaagatatcttaatggagcagtgctctcaaacagagtttggatttgtctcctctgactctctcctcaacccatcgcagaagagctcttacattaactctaagccctacgagtcttttctaaactttaatgacgaagaaagccaagatcagcatccccttcgtcaattcattgatgagtggccgaaggatcaatctaattgttctgtcattagctggccagaagagttgaaatctgactggacccagctctccatgtcaatcccaatggcctcatcagacttctcatcatcatcatcctcacccacacaagagaaacttgccctctcaccaatgagtttatcttgcgagtttgaccctgtacaaatgggtttaagggtgagcgttgaccataatgaatcaagccaaaagcaaaccaactggatacctatctcctgggggacttcaattggtggccctttaggagaggtcttgaccaccagcactagccatgcggattcctgcaagagctcatcagcccttagccttttgagagaaggttgtgatggcagcccacagttgggatcttctccgacgggagtcttgcagaaatcaactttctgttccctttccaatagcagttctgggagcagcccaagagctgagagcaagaaaaacaatgacactgctagtctgtatgaggatgtgggtggttcgataattgcaagttcatcacctattccacccctgtaatcaagcgaactgtaaggatgaaacctgtcaaggaaatgtgaagaagcttggagtttctatttatctgataaattcctgta

SEQ ID NO: 56 - protein, 607 aa, Populus tremuloides
MDFGVLGLEGLVGPETSSEAPSHVSPPETKPKILGSVLSKRERSASSAQDDYWRTSKMPKNDDFSVTKTMSLHQPTSLLRSNYMLSDDSRQQEHMMSFSSPRPETTPFLSKDGELVERSTQNHTALSFRYHQNTASSYIRSAGYDTGGLNAGMHGPLTGVRGPFTPSQWMELEHQALIYKYITARVPVPSNLIIPLKKSVYPYSLPGSSTGSFPHNSLGWSAFHLGYPGNNTDPEPGRCRRTDGKKWRCSRDAVADQKYCERHINRGRHRSRKPVEGQTGHAATGTASSKVVPMSNSMSKLAITSGGASNSIAMTTQQQFKILQPAAANTSADVDVNRAQDAQSISMMSSTINRKSDESSFFVPKQDILMEQCSQTEFGFVSSDSLLNPSQKSSYINSKPYESFLNFNDEESQDQHPLRQFIDEWPKDQSNCSVISWPEELKSDWTQLSMSIPMASSDFSSSSSSPTQEKLALSPMSLSCEFDPVQMGLRVSVDHNESSQKQTNWIPISWGTSIGGPLGEVLTTSTSHADSCKSSSALSLLREGCDGSPQLGSSPTGVLQKSTFCSLSNSSSGSSPRAESKKNNDTASLYEDVGGSIIASSSPIPPL

SEQ ID NO: 57 - DNA, 1848 bp, Populus tremuloides
aagtaatagtggtttcgcttctcttgctagttcagatcctgaagcaaagcagaagtacggatctgggttcctgaagcaagagagatctgccgcagccgatgacgattggaggaactctaaattggccaaaaccgagtcaatgctgcttgaccagagaaacacttttcttctgaaatctagcaacaactctctcttcactgatggacagcagcagcagcagatgctcagcttctcctgtcccaaatcagcttcttcaggggagagaagctccccaaatgccatgttgccatactttcacctcacatcttctgcttgtaatagaaatacaggctacaactctggaatcttcaatgctgccagcatgcatggggttttgactgagactagatggccattcactcaattacaatggatggagcttgaacatcaggccttgatctacaaatacatgactgcaaatgtgcctataccatctaatctgctcatccccattaggaaagctcttgattctgctgggttttctagcttttctggtggacttttcaaacccagtgcattgcaatggggtactttccatatgggtttctccagcaacactgatccggagccaggacggtgtcgaagaacagatgggaagaaatggcggtgctcaagagacgcagttgctgatcagaagtattgtgagcggcacatgaacaggggtcgccatcgttcaagaaagcctgtggaaggacaatcaggccattccgctgcggccaccaccactttaaagccaatggccaatggcacttcctcttttgcatcagcatcagtggtggggcttcgcagcgctgtgtccgacagccacactattgtgcataatcagcagcaacctgccagttcttctaatctttctgccaccaatacgctcagcagggtgttcctcgctacagagaatgtaggtgagagaatgcaagatgcatcgggcttatccatgctaccatccagcattgacctgaaatccaaagaaactccattcttcatatcaaaacaacagaactcttacggtgaatccctgcaaaatgagtttgcacttgtcacctccgactccctcctcaaccattcacagaaaagctcgtccttgatgagttgcagaaattttggttcgtctcaggaccttactgaccaggaatctgtttcacagcactccctccgccaatttatggatgattgtcctaaaagtcattctgatcgctctgctgttgcttggcctggacttgatctgcaatctgagagaacccagctatcaatttcaatccccatggctcctgcagactttgtgtcatccacttcatcttcaaacaatgaaaagatctctctctccccgctgagattatcgcgtgaatttgatccaataaagatggggctgggagtgggagccggtagtgtcgccaatgaaccaaaccaaaggcaagcgaattggattcccatttcttgggaaacttcaatgggtggtccacttggggaggttttgcacaacaccaataataatgcaacagcagaatgcaagaatgaatcatcgctcaacctaatgacagagagatgggacaacagtcctcgggtaggctcatctcctaccggggtcttacaaaagtctgcctttgcttctctttcaaatagcagtgctggaagcagcccaagagcagagaacaagaccattgaaggtggcaatctctgcaatgaccttggatctactatcgtgcattcttcatcattgcctgccttgtaactctctgacctgccatttaagaagtcttcagctgatgccagattatgaataatttgttttttaaagttctcaatcagtct

SEQ ID NO: 58 - protein, 605 aa, Populus tremuloides
MDFGVQVGLDGLVGSDTSNSGFASLASSDPEAKQKYGSGFLKQERSAAADDDWRNSKLAKTESMLLDQRNTFLLKSSNNSLFTDGQQQQQMLSFSCPKSASSGERSSPNAMLPYFHLTSSACNRNTGYNSGIFNAASMHGVLTETRWPFTQLQWMELEHQALIYKYMTANVPIPSNLLIPIRKALDSAGFSSFSGGLFKPSALQWGTFHMGFSSNTDPEPGRCRRTDGKKWRCSRDAVADQKYCERHMNRGRHRSRKPVEGQSGHSAAATTTLKPMANGTSSFASASVVGLRSAVSDSHTIVHNQQQPASSSNLSATNTLSRVFLATENVGERMQDASGLSMLPSSIDLKSKETPFFISKQQNSYGESLQNEFALVTSDSLLNHSQKSSSLMSCRNFGSSQDLTDQESVSQHSLRQFMDDCPKSHSDRSAVAWPGLDLQSERTQLSISIPMAPADFVSSTSSSNNEKISLSPLRLSREFDPIKMGLGVGAGSVANEPNQRQANWIPISWETSMGGPLGEVLHNTNNNATAECKNESSLNLMTERWDNSPRVGSSPTGVLQKSAFASLSNSSAGSSPRAENKTIEGGNLCNDLGSTIVHSSSLPAL

SEQ ID NO: 59 - DNA, 1053 bp, Populus tremuloides
atggcaagagcttgaacaccaagctctcatttacaaatacatggtctctggtgttcctgtcccgccagaactcctctattctgtcaaaagaagcttgggatcttctttggcatcaagactcttccctcaccaacctattgggtggggttgttttcaggcgggttttggcagaaaagcagacccagagccaggaaggtgcagaagaacggatggaaaaaaatggaggtgctcaaaggaagcatacccagactcaaaatattgtgagaggcacatgcacagaggcagaagccgttcaagaaagcctgtggaacttacttcaagtactactacaacagcaacaacaattcctttaacatcaatcaacagaaacctctctaaccccactatttcaccctccagctcctcttattctttctctcacccttcatctgcggaatctgaagtttatgcccatcaaaacccttcgcatggaaccttccttaaccccttcctttatcctcattcttcatcttctggacctcctgattctggtttttcacctctaaatagcacccctcacaacctgtttttggagtctggatcttctcctcaagttgacaaagagcacaggtattatcatggaatgagggaggatgtggatgagagagctttctttccagatggtttagggagtgcaagaggtgttcaagattcatataaccaattgacaatgagttcctacaaaggttactcactgtcacagtttcaaacctttgctgatacttctaaagaagagcagcaacaaccagggcagcactgctttgttttgggcactgatattatcaagtcatcagcaacaaggtcaatcaagttggagaaagaaactgaaaccctgaagccattgcaccatttctttgatgaatgggaaccaaaggacgcagactcttggcttgatcttgcatccagttcaagacctcacacttctgatgattgaagtctcaataatggatctttgtaatatgacgaaaacagtacttgttcgtgggtcatcaatgcctttcttgcctcaaatga

SEQ ID NO: 60 - protein, 340 aa, Populus tremuloides
MLNTTISRNRFPFTATQWQELEHQALIYKYMVSGVPVPPELLYSVKRSLGSSLASRLFPHQPIGWGCFQAGFGRKADPEPGRCRRTDGKKWRCSKEAYPDSKYCERHMHRGRSRSRKPVELTSSTTTTATTIPLTSINRNLSNPTISPSSSSYSFSHPSSAESEVYAHQNPSHGTFLNPFLYPHSSSSGPPDSGFSPLNSTPHNLFLESGSSPQVDKEHRYYHGMREDVDERAFFPDGLGSARGVQDSYNQLTMSSYKGYSLSQFQTFADTSKEEQQQPGQHCFVLGTDIIKSSATRSIKLEKETETLKPLHHFFDEWEPKDADSWLDLASSSRPHTSDD

SEQ ID NO: 61 - DNA, 1265 bp, Populus tremuloides
tcttcttttctcttccagggtaatatgataatgagtggaggaaacaggtttcccttcactgcatcccagtggcaagagcttgagcatcaagccctaatctacaagtacatggtttcaggcatccccatccctcccgatcttcttttcaccatcaaaagaagtggctgcttggactcttcactctcttcaaagctctttccttgccaacctccacatttttcctggggctgttttcagatgggtttgggaaggaaaatagatccagaaccggggaggtgcaggagaactgatggaaagaaatggagatgctcaaaagaagcatacccagattctaagtactgtgagaaacatatgcatagagggaagaaccgttcaagaaagcctgtggaagttgcaacacaatcaataacagcaccaactgtctcatcaatgaccagaaaccactctaataattcactactaacaacatcccccacctctctttcgttattgtcacctaagacccaccaccagaatcaccttcactatcctgctcctgcaggttatcatgcccatccaaatcatcaattcttgtcttcttccagaccccttgggattggtctgtcccctcatgaaaatcctactcacttgcttttggactctggtggttcttctctggccaatacagattacagaagaaacaggaatgtttatgggctgaaagaggaggttgatgagcatgctttcttctcagaaccttcaggttctatgagaagcttgtccggttcatctttggatgatgcttggcaactcaccccactcacaatgaactcttctccttctaccaccaactcttcaaagcaaaggagcttgtctagtttacacaacgaatattcttacttgcagcttcaaagcctgagtgatcccgataccccaaaacaacaaaagcagtgtcaacataactatcttctgggaagtagtgatgtagacagtctagggcccataaaaatggagaaggaaaaatcccaaaagactgttcaccgtttctttgatgaatggccaccaaaggataaagattcatggcttgatttggatgacaaatcatcaaaaagtgcatcagtttcagcaaccggactctcaatatccattccctcctctcatgactttcttccaatcttcagttcaagaactaataatggtggttgattttactctggtgggtttctggcccaagatgtacttggtgggaaggggggggtcaccgccttctgtcaagaggcctcaga

SEQ ID NO: 62 - protein, 386 aa, Populus tremuloides
MIMSGGNRFPFTASQWQELEHQALIYKYMVSGIPIPPDLLFTIKRSGCLDSSLSSKLFPCQPPHFSWGCFQMGLGRKIDPEPGRCRRTDGKKWRCSKEAYPDSKYCEKHMHRGKNRSRKPVEVATQSITAPTVSSMTRNHSNNSLLTTSPTSLSLLSPKTHHQNHLHYPAPAGYHAHPNHQFLSSSRPLGIGLSPHENPTHLLLDSGGSSLANTDYRRNRNVYGLKEEVDEHAFFSEPSGSMRSLSGSSLDDAWQLTPLTMNSSPSTTNSSKQRSLSSLHNEYSYLQLQSLSDPDTPKQQKQCQHNYLLGSSDVDSLGPIKMEKEKSQKTVHRFFDEWPPKDKDSWLDLDDKSSKSASVSATGLSISIPSSHDFLPIFSSRTNNGG

SEQ ID NO: 63 - DNA, 644 bp, Populus tremuloides
ctagggactggactgctaaacggttggaacatggagggaaataggcgcaatggtcggtctcggtcaccttcaattgggctaggagttgagcttggacgtggtggttctagtcaaagaccaataactggctgcaaaaaaccttatgggttcactattcttcaactgcatgagctagaacttcagtctcttatctacaagtatatccaagctggatttcctgtaccttaccatcttgttttacctatatggaaaagtgttactgcttcccttggtggtctcagttcaagcttgtaccagctctaccctagctttatggggtgtaagtgtaacccattatatttggaatataagaaaggaatggaacatgagccagggagatgtaggagaacggatggaaagaagtggaggtgtagcaaagaggttcttccagatcaaaagtactgtgacaggcacatacacagaggacgccagcgttcaagaaagcttgtggaagctgcttctcatagtaatgccagcaccaacctctccatttctctccctggaatcggtagtgctagcgcctagcagtactaatctctctccaatatgttgtctctctccaaagagtgttctccacaagaaatatgtaataggagcagctgcta

SEQ ID NO: 64 - protein, 177 aa, Populus tremuloides
MEGNRRNGRSRSPSIGLGVELGRGGSSQRPITGCKKPYGFTILQLHELELQSLIYKYIQAGFPVPYHLVLPIWKSVTASLGGLSSSLYQLYPSFMGCKCNPLYLEYKKGMEHEPGRCRRTDGKKWRCSKEVLPDQKYCDRHIHRGRQRSRKLVEAASHSNASTNLSISLPGIGSASA

SEQ ID NO: 65 - DNA, 1154 bp, Populus tremuloides
caagtgaagttgaagagagaagtgaaagaaatgagcaactcatcagtcacagtggcgggggtgggatcaagatcaccaccaggtttcacgatgtctcagtggcatgagctggagcatcaagttcttatctttaagtgtttaaatgcagggttacctgtccctccttcccttctccttcctattcgtaagagttttcagcttctttcccctggtttcttgcacccatcaaatttgagctactgttcctattttgggaagaagattgactcagagccagggaggtgtcggaggacagatggcaagaaatggaggtgctccaaagatgctcacccagactccaagtactgtgagcggcatatgaatagaagccgtaaccgttcaagaaagcctgtggaatcacaaactacctctcagtccttgtcaactgtggcatcagaaattgcaactgggagcagcagcattgggagcagagggtatccaactaatcctgggaccttaggtttgggaagtaatatgtcacgttggcagatggagtctatgccttatggtgttaatagtaaagactacaggtctctccatggaccgaagcctgaagcagatgagaaaactttcctaccagaagctttgggaaatacaagaagctttggaatgaactctactgtggacagcacttggcatctcacatcccaagtccctgcaaaccctgtgccagaatcaagaaatggttctcttttgcaaaactacccacaagtacagacactgcaggattttgagcccctaactgttgatgctgcatcgccaaaacaacagcagcagcagcattatttatttggaagggagttcagttcatcaggatctatgaggcgggaaaatcagtctcttcagcctctctttgacgagtggccaaaatgcagggatatggattcccatctcactgatcaaagatctaacaataactcgtctgctgttcagctatcaatggccattccaatggctcctaaccctgctgcgaggagttatcattccccaaatggtgagacaggtttatctggaacatacttttccgcaacctagacgcccccaagacttggtggaaaacaaatagatgagttctaatcctctcatgttataatgcagatgcttgaaaggagcat

SEQ ID NO: 66 - protein, 347 aa, Populus tremuloides
MSNSSVTVAGVGSRSPPGFTMSQWHELEHQVLIFKCLNAGLPVPPSLLLPIRKSFQLLSPGFLHPSNLSYCSYFGKKIDSEPGRCRRTDGKKWRCSKDAHPDSKYCERHMNRSRNRSRKPVESQTTSQSLSTVASEIATGSSSIGSRGYPTNPGTLGLGSNMSRWQMESMPYGVNSKDYRSLHGPKPEADEKTFLPEALGNTRSFGMNSTVDSTWHLTSQVPANPVPESRNGSLLQNYPQVQTLQDFEPLTVDAASPKQQQQQHYLFGREFSSSGSMRRENQSLQPLFDEWPKCRDMDSHLTDQRSNNNSSAVQLSMAIPMAPNPAARSYHSPNGETGLSGTYFSAT

SEQ ID NO: 67 - DNA, 1875 bp, Populus tremuloides
tagtcatgctccttctcatgtctcacttcctgagaccaaaccaaagattcttggatctgtgttaactaagcaagaaagatcatcttcatctgcatcagctcaggatgattactggagggcttcaaagatgccaaaacttgatgatttctcttccaccaaaacaatgccactgcaccaacccgctcctttgctgagacctaattctatgttttctaatgattctcgccaacaagagcacatgctaagcttctcttctccaaaaccagaagctactccatttctcgttaaagatgctggcttggttgagagaaacacacaaaaccacactgccttgagttttccttactaccagcacgcacctctttccgctagcagaagtgcaggttatggcactggaaacttgaatgcaagcatgcaggggccttttactggggttagaggaccatttactccatctcagtggatggagcttgaacaccaggccttgatctacaaatacatcactgcacgtgtgcctgtgccttccaatttaatcattcctctcaagaaatctctcaacccttatggcttacctttttcctctgctggatcattccctcccagttcattgggatggggcactttccaccttggttaccctggcaacaacactgatcaggagcctggaaggtgtcgtcggactgatggcaagaaatggcggtgctcaagggatgctgtagctgaccaaaaatattgtgaaaggcacataaacagaggccgccatcgttcaagaaagcctgtggaaggccagactggccatgctgctactgggactgccagttcaaaggtggtgccaatgtctaactccatgccaacctcgattacaaccagtggcgctacctcgaacagcattgtgatcacacagcaacagttaaaaaattttcagccggctgctgcttccatctcttctgcagatgctcgtgtcaacggagcacaagatgcacggagggtttctatgatgtcttccactatcaaccggaaatctgacgagtctactttctgtattcctagacaagatatcctatttgaacagtgctctcaaacagagtttggacttgtctcctatgattctctcctcaacccatcgcagaagagctcttactttaacgctaaaccctacgagtcttttctaaactttagtgatgaagaaagccatgatcagcatccccttcgtcaattcattgatgactggccgaaggaccaatcaaatcgttctgtcattagctggccagaagagttgaaatctgactgtacccagctctcaatgtcaatctcaatggtctcgtcagacttctcgtcgtcatcatcctcacttctgcgagagaaacttgccttctcaccattgaggttatctcgcgagtttgaccctatacaaatgggtttaagggtgagcggtgaccataatgaatcaagccagaagcaagccaactggatacctatctcttggggaacttcaattggcggccctttaggagaggtcttgaccaccagcgccagccatgcggattcctgcaaaagctcatcagctcttaaccttttaagagagggttgggatggcagcccgcagctgggatcttctccaacaggagtcttgcagaaatcgacttttggttcactttcaaatagcagttcaggtagcagcccaagagcagagagcaagaaaaacaatgaaagtgctagtctgtatgaggatgttgttggttcgataattgcaagtgatcccctattccatccctgtaatcaagaaaatggttaggatgaaacttgtgaagaagaagcttggagttatttatcttattaatttctgcagactgtttctccttgttgcttgttccc

SEQ ID NO: 68 - protein, 555 aa, Populus tremuloides
MPKLDDFSSTKTMPLHQPAPLLRPNSMFSNDSRQQEHMLSFSSPKPEATPFLVKDAGLVERNTQNHTALSFPYYQHAPLSASRSAGYGTGNLNASMQGPFTGVRGPFTPSQWMELEHQALIYKYITARVPVPSNLIIPLKKSLNPYGLPFSSAGSFPPSSLGWGTFHLGYPGNNTDQEPGRCRRTDGKKWRCSRDAVADQKYCERHINRGRHRSRKPVEGQTGHAATGTASSKVVPMSNSMPTSITTSGATSNSIVITQQQLKNFQPAAASISSADARVNGAQDARRVSMMSSTINRKSDESTFCIPRQDILFEQCSQTEFGLVSYDSLLNPSQKSSYFNAKPYESFLNFSDEESHDQHPLRQFIDDWPKDQSNRSVISWPEELKSDCTQLSMSISMVSSDFSSSSSSLLREKLAFSPLRLSREFDPIQMGLRVSGDHNESSQKQANWIPISWGTSIGGPLGEVLTTSASHADSCKSSSALNLLREGWDGSPQLGSSPTGVLQKSTFGSLSNSSSGSSPRAESKKNNESASLYEDVVGSIIASDPLFHPCNQENG

SEQ ID NO: 69 - DNA, 1715 bp, Populus tremuloides
aaaaattattcttctttatttttcatcatgatgacaacagatgatggcttaaacgtttcaaacaaggtagctaaggaaataaacactactagtagtattagtaatgttgattttggtgtgaagctacatcaacctattgatcatcatcaatcatttccttctagtactcctatgatggttcctcatgttaatcaccaccgtccaatgtttgacaatggtcccacatcatcatgtgatagaaacaagtctttgatgaactatataagtgatcgtatataccgtgttgctgctggtggtgctaccagtggcggtgcagttggggttaggaatttgcagccttttgacatttctgaaacaagtatctctacagcagcttctgccttcagatccccaggaggcaacatggcagcgtctttggggtttccttttacaaatacacagtggaaagagcttgaaagacaagccatgatatacaactatataacggcctcagtccctgtgcctcctcaatttctaattccaaccccaatggggaatggattgaatgtaaggttctcaaatggggcagatctagaaccagggaggtgtaggagaacagatgggaagaaatggaggtgctcaagagatgtggcacctgatcagaaatactgtgagcgtcatatgcatagaggcagaccccgttcaagaaagcatgtggaactcaatgctagcaacaataacaacaagaagaaccgccataatcctgctatttgtccagaagctcctgttaccgtggccatttctaaacccacaatcaacaacagcaacagtggctctgcctctcacgatcagttttttgggcctatgcctcagccatatatccagaccccagtttttgtaaacaaaaccagcgagaagacttcaacttatgatgttaatggagcctatggttccacattcaaagaacccaggagcttggactggatgttgaaaggggaagctggtcctatagccaaaaatgatcaacaatggccacatctagtgcacaaagaaattgaactagctactgaaggttcctttaacagtgcttctgttctcaaacagcattaccaaggagagtctttgaatttgaactcatttggaaattttaatgctagagaagaccaacaaagcaatcaatatagtctgtttcttgatgaggctccaaggagttttattgatgcatggtctaatgatgcaatttctagaaacacaagttctgtttcctcagatgggaagctccatctttcccctctcagtctatcaatgggaagcaataggtctactgatgatgaaatgggtcagatccaaatgggtttaggcctaatcaaatcagatcgaaatgaagaatgtggtaacactagcagcgccccaggtggccccttggcagaggtgttacaactgaggacaagcaacaccacaggaaccaatcaatcttcttctatgatggaaaatggtgattctattagtcctccagctactacagtctcttctccatctggggttttgcagaaaacacttgcctcattttctgatagcagtggtaatagcagtccaactcttgccagttcaaggaccaaacctgaaattgccatgctttggttaaatcaaggctaaatgtgccactctctagttagttaagggcacacaaggccataagggcaatataaatttttataagcttgatatatttttat

SEQ ID NO: 70 - protein, 535 aa, Populus tremuloides
MMTTDDGLNVSNKVAKEINTTSSISNVDFGVKLHQPIDHHQSFPSSTPMMVPHVNHHRPMFDNGPTSSCDRNKSLMNYISDRIYRVAAGGATSGGAVGVRNLQPFDISETSISTAASAFRSPGGNMAASLGFPFTNTQWKELERQAMIYNYITASVPVPPQFLIPTPMGNGLNVRFSNGADLEPGRCRRTDGKKWRCSRDVAPDQKYCERHMHRGRPRSRKHVELNASNNNNKKNRHNPAICPEAPVTVAISKPTINNSNSGSASHDQFFGPMPQPYIQTPVFVNKTSEKTSTYDVNGAYGSTFKEPRSLDWMLKGEAGPIAKNDQQWPHLVHKEIELATEGSFNSASVLKQHYQGESLNLNSFGNFNAREDQQSNQYSLFLDEAPRSFIDAWSNDAISRNTSSVSSDGKLHLSPLSLSMGSNRSTDDEMGQIQMGLGLIKSDRNEECGNTSSAPGGPLAEVLQLRTSNTTGTNQSSSMMENGDSISPPATTVSSPSGVLQKTLASFSDSSGNSSPTLASSRTKPEIAMLWLNQG

SEQ ID NO: 71 - DNA, 1053 bp, Populus tremuloides
agcagcggggatggcagctgggggaatggggacagcagcgatgacaatgaggtcaccatttacagtgtcacagtggcaagaactggaacatcaagctttgatctataagtacatggtggcaggtctgcctgttccacctgatcttgtgctccctattcagaggagctttgaatccatttctcatagattcttccaccatcccaccatgagctattgcactttctatggcaagaaggtggatccggaaccaggtcgatgcaggaggaccgacggcaagaagtggaggtgctccaaagatgcctacccagactccaagtactgtgagcgccacatgcaccgtggccgcaaccgttcaagaaagcctgtggaatcacaaaccatgacacagtcatcgtccaccgtgacatcactgactgttacaggaagcagcagtggaactggaagcttccagaaccttccattgcacacatatagcaatccccagggcactgcttctggaactaaccaatcatattatcatatgaactccattccctacggaatcccaaccaaagattacaggtatcttcaagaacttacgcctgaaggtggggagcatagcttcttgtctgaagcctcaggaagcaacaaggggcttcagatagactcacagctggacaatgcatggtctttgatgcaatccagagtctcatcattccccacagagaaatcaactgaaaactcgatgttgcaaagtaatcatccccagcattcatttttcagtagtgatttcaccaccagggaatctgtgaaacaggacgggcagtctcttcgacccttctttgatgagtggcctaaaaaccgagatgcctggtctggcctcgagaatgatagttccaaccagacctcattctctacaacgcagctgtcgatatccattccaatggcctcatctgacttctccacaagttgtcgttctccacgagataactaagaggacactaagaattcacaaaacaaagccaaaggtggtcctggccaaagattaacacatacttgtgttaaatttttgtg

SEQ ID NO: 72 - protein, 320 aa, Populus tremuloides
MAAGGMGTAAMTMRSPFTVSQWQELEHQALIYKYMVAGLPVPPDLVLPIQRSFESISHRFFHHPTMSYCTFYGKKVDPEPGRCRRTDGKKWRCSKDAYPDSKYCERHMHRGRNRSRKPVESQTMTQSSSTVTSLTVTGSSSGTGSFQNLPLHTYSNPQGTASGTNQSYYHMNSIPYGIPTKDYRYLQELTPEGGEHSFLSEASGSNKGLQIDSQLDNAWSLMQSRVSSFPTEKSTENSMLQSNHPQHSFFSSDFTTRESVKQDGQSLRPFFDEWPKNRDAWSGLENDSSNQTSFSTTQLSISIPMASSDFSTSCRSPRDN

SEQ ID NO: 73 - DNA, 1682 bp, Populus tremuloides
gtctgttcttgtttttgtagatacacgacaatggagaaaagagtatctgaagaatcagcgccgtcgatgaaactgtctcttgggattggtgctggtgatcatggtgatgatgatcaagatgatagacacgtgttcccacagttaacagagactcagttgcatgagcttaaacagcaagctttgatattcaagtacatagtagctggtcttcgcgtgcctcctgatcttgtagttcccatttggcatagtgttgctagcagctctcttggttcatttagtggtgctgatatttataggcaattcccaagctttgtgggattaagtcctcagggatttgattatagacaaatgatggatccagaacctgggagatgtagaagaactgatgggaagaaatggaggtgtagcaaggatgtagttgctggtcagaagtattgtgaacgccatatgcatagaggccgtcaacgttcaagaaagcttgtggaagcttctcaaactgctgctgcttctgaaaaaccatcacctcacaattcaagcaagaattcagacaatccaaccactcattcttctaatttagccaaagtaagttcacagataaaagccccacctcttaataatacccccaccattttaaccacttgcaccacaagttgcaattctgacattgaaatcactggcatgagcttggccactactgctaattctgactgcaaaaacccctttacaaccatgactactagcattgttaccggctacaagaacactgcaacaatgatcgctagtgctgttcatgctgacattacagccactggtaacgactacaagagtagcatcaacttaaagagacactacattgatgacagaaacagtaattgcagcaactctgttacttacaagggtataatcgacagaaactgcagcaacaaaaaaataaaaaatgctggtagcaatgtatctcaaggattgaacttctccccgaagagtgttcttcaagttcaaggttgcggcgcctcacacatttacatgaatgatgtggaacttgaactgggaaggtgtagaagaacagatggaaagaagtggcgatgccgcagggatgttgtagctaatcagaagtattgcgagatgcacatgcaccgaggttctaagcagcacttggaagcgtccaaacctgctgcaattcccgctacaatcccatttgtccctgggaatgttcattcatatcctgcaacgaacttgccaagtaaagcagatcgcagaagcttaaacaccgatctctgtatttcgatcccaacaagtcctcaactgatcatgaccaatgatgatacaagaactatcagcaatagcagtgacactaccataagcgacaccatgaggggcaccacaccaggactggtatcaacacatgcaggtagtggggatcccaaaagtcctcctggtggtgacagagccaggttattaaagaaagctgaagttatggaggcggcggtagagatttacgaggaagtacaatccggccgtggggtcagaagttttatccaaggcagaagacttccaacttttccctatgtttatatcacacctctgctgttaatctgcaattaattctagtcaaaccatgtgattaaagttacaagaggtgtaagagaagaataacgtttaattccatcctatgcagacaactg

SEQ ID NO: 74 - protein, 523 aa, Populus tremuloides
MEKRVSEESAPSMKLSLGIGAGDHGDDDQDDRHVFPQLTETQLHELKQQALIFKYIVAGLRVPPDLVVPIWHSVASSSLGSFSGADIYRQFPSFVGLSPQGFDYRQMMDPEPGRCRRTDGKKWRCSKDVVAGQKYCERHMHRGRQRSRKLVEASQTAAASEKPSPHNSSKNSDNPTTHSSNLAKVSSQIKAPPLNNTPTILTTCTTSCNSDIEITGMSLATTANSDCKNPFTTMTTSIVTGYKNTATMIASAVHADITATGNDYKSSINLKRHYIDDRNSNCSNSVTYKGIIDRNCSNKKIKNAGSNVSQGLNFSPKSVLQVQGCGASHIYMNDVELELGRCRRTDGKKWRCRRDVVANQKYCEMHMHRGSKQHLEASKPAAIPATIPFVPGNVHSYPATNLPSKADRRSLNTDLCISIPTSPQLIMTNDDTRTISNSSDTTISDTMRGTTPGLVSTHAGSGDPKSPPGGDRARLLKKAEVMEAAVEIYEEVQSGRGVRSFIQGRRLPTFPYVYITPLLLICN

SEQ ID NO: 75 - DNA, 1812 bp, Populus tremuloides
aagtaatagtggttttgcttctcttgctggctcagatcctgaagcaaagcagaagttgtacggatctgggttcttgaagcaagagagacctggcaacatcgatggtgattggaggagctctaaattgtcgaaaactgagtcaatgctgcttgagcagagtaacacttcacttctgaaatctagctccaactttctcttcgctgatggacagcagcagcagcagcagatgctcagcttctcctatcccagatcagctccttcagcggagagaagctcccaaaatggcacattgccctctggtatctacaatgctgccagcatgcatggggttttgaccgagaccagatggccattcactcaatcacaatggatggagcttgaacatcaggccttgatctacaagtatatagcagcaaatgtgcctataccatctaatctgctccttcccattagaaaagctcttgattctgctgggtttcctagcttttctgctggatttttcaggcccaatacattgccatggggtgctttccatatgggtttctccagcaacactgatccggagccaggacggtgtcgaaggacagatggaaagaaatggcggtgctcaagagatgcagttgccgatcagaagtattgtgagcggcatatgaacaggggccgccatcgttcaagaaagcctgtggaaggccaatcaggccattccgctgcagccgccaccactgtaaagccagccaatggcacttcgtcttctacatcatcatcagtggtggggcttcgcagcactgtgtccgacagcctcactattgctcataatcagcagcaagcagctagtccatctaatctttctgcctctaatacgctcagcaggatgttccttactaaagagaatgtaggtgagagaacgcaggatgcgacagccttgtccatgcttcgatccaacatggatcttaaatctaaagaaactccattcttcatatcaaaacaacaaaactcatatggggaatccttacgaaatgagtttggacttgtcacctccgactccctcctcaatcactcacagaaaagctcatctttaatgagttgcagaaattttggttcgtctcaggacctcactgaccaggaatctgtttcacagcactccctccgccaattcatggatgattggcctaaaagtcagtctgatcgttctgctgtttcttggcctgaacttgatcagcaatctgagagaacccagctatcgatttcaatccccatggctcctgcagacttcatgtcatctacttcctccccaaacaatgaaaaagtcactctctccccattgagattatcacgagaatttgatccaatacagatgggactgggagtgggaggtggaggtggtggtattgccaacgaaccaaaccaaaggcaagccaactggattcccatttcttggggaacttcaatgggtggtccgctcggggaggtcttgcacaacaccaataacaatgcagcagcagagtgcaagaccacgtcatcgctgaacctgatgacctatagatgggacaacagtcctcgtataggttcatctccaactggggtcttacaaaagtcagcgtttgcttccctttcaaatagcagtgcgggaagcagcccaagagcagagaacaagaccaatgaaggtggcagtctctgcaatgacctccttggatccactattgtgcattcttcttcattgcctgccatgtaactctgttgatctgctgccatccaagaagtctcctgtcatcgtagctgacaaaacatggagcactttgtttttgaagttgt

SEQ ID NO: 76 - protein, 529 aa, Populus tremuloides
MLLEQSNTSLLKSSSNFLFADGQQQQQQMLSFSYPRSAPSAERSSQNGTLPSGIYNAASMHGVLTETRWPFTQSQWMELEHQALIYKYIAANVPIPSNLLLPIRKALDSAGFPSFSAGFFRPNTLPWGAFHMGFSSNTDPEPGRCRRTDGKKWRCSRDAVADQKYCERHMNRGRHRSRKPVEGQSGHSAAAATTVKPANGTSSSTSSSVVGLRSTVSDSLTIAHNQQQAASPSNLSASNTLSRMFLTKENVGERTQDATALSMLRSNMDLKSKETPFFISKQQNSYGESLRNEFGLVTSDSLLNHSQKSSSLMSCRNFGSSQDLTDQESVSQHSLRQFMDDWPKSQSDRSAVSWPELDQQSERTQLSISIPMAPADFMSSTSSPNNEKVTLSPLRLSREFDPIQMGLGVGGGGGGIANEPNQRQANWIPISWGTSMGGPLGEVLHNTNNNAAAECKTTSSLNLMTYRWDNSPRIGSSPTGVLQKSAFASLSNSSAGSSPRAENKTNEGGSLCNDLLGSTIVHSSSLPAM

SEQ ID NO: 77 - DNA, 1017 bp, Populus tremuloides
agtgatgaccatgaggtcgccatttacagtatcgcaatggcaagaactggaacatcaagctttgatctataagtacatggtggcaggtctgcctgttcctcctgatcttgtgctccctattcagaggagttttgagtccatttctcatagattcttccaccatcccgccatgggctattgcactttctatgggaagaaggtggatccggagccaggtcaatgcaggaggaccgacggcaagaagtggaggtgctccaaagatgcatacccgggctccaagtactgtgagcgccacatgcaccgtggccgcaaccgttcaagaaaggctgtggaatcacaaaccatgacacagtcatcgtccactgtgacatcactgactgtaacaggaagcagcagtggaacagggagcttccagaaccttccactgcgcacatatggtaatccccagggcactggttctggacctaaccaatcccattatcatatgaactgcattccccgtggaatcccaactaaagattgcaggtatcttcaaggactgaagactgagggtggcgagcatagcttcttgtctgaaccttcaggatgcaaaaggggtctccagaaggactcacagctagacaatgcctggtctttgatgctatccagaggctcatcattccccacagagaaatcgactgacgactcgacgttgaagaatgattatccccagcattcatttttcagtagtgatttcaccaccggagaacccgtgaaacacgaagggcagtctcttcgacccttctttgacgagtggcctgaggaccaggacatttggtctggcctcaaagataatagatccaactccacctcattctctacaacgaagctgtcgatgtccattccaattgcctcatctggcttctccacaagttctcgttctccacaagaaaactgagaggacagaatgagaatttacaaagcacgatcaaaggtgatcctcaaccaaagattggtgtgttaacttgaaaactccta

SEQ ID NO: 78 - protein, 310 aa, Populus tremuloides
MTMRSPFTVSQWQELEHQALIYKYMVAGLPVPPDLVLPIQRSFESISHRFFHHPAMGYCTFYGKKVDPEPGQCRRTDGKKWRCSKDAYPGSKYCERHMHRGRNRSRKAVESQTMTQSSSTVTSLTVTGSSSGTGSFQNLPLRTYGNPQGTGSGPNQSHYHMNCIPRGIPTKDCRYLQGLKTEGGEHSFLSEPSGCKRGLQKDSQLDNAWSLMLSRGSSFPTEKSTDDSTLKNDYPQHSFFSSDFTTGEPVKHEGQSLRPFFDEWPEDQDIWSGLKDNRSNSTSFSTTKLSMSIPIASSGFSTSSRSPQEN

SEQ ID NO: 79 - DNA, 1221 bp, Populus tremuloides
acaaccctctgcaaagatgccaaaactcctcatggatccccatcaaccacaacaacatccacactcatctgggtctgctgccttccctttgtttctacccgagcccagctgcaaaaatagtaacctgtcagcatttcctgattcaaacacagctgcaaacaccagacttcctaagatcatggggaattactttagcctggaacagtggcaagagctagagctgcaggctttgatctacagattcatgttagccggtgcagctattcctccggagctcctccaaccaatcaagaaaacccttcttcattctcacccccctccatatttcctccatcatcctcttcaattacattgctcttattatcagccatcttggtattggggaagagcagccatggatccggagccaggtcggtgccggagaacagatgggaagaaatggcggtgctccagagacgtggtggcagggcacaagtattgcgagcgccacttgcaccgtggccgcaaccgttcaagaaagcctgtggaaaatcccacacctacaatatccactaacatcacttgcattggtattggaggtgcgggtggtaccgcatcagctgctgctttcaattgcagcaccacaccaaccatatcagaggtggtcaatgagactcatttttcgcatacactagaatccccttccattcatctcaatcatagctccaaaactgaaagcaagggcttaattggaccaccacctccaaatgaggttggtaacaggtctgatggccacattctgtggcatttttttgatgactggccacgatccgttgatgaatccgacaatatgaatgctggaagctcaatgaactctttaacctgcctctccgtttcaatgcctggaaactcaccagcatcagatgtgtcattgaaattgtccactgggaataatattgcagaggaggagccggagccagtcccagccccgatccctagaggcaatacaagcaattgggctgctgcaggatggggcacaaaaattacaaaccaggtggtgacttcaatggggggacctcttgctgaggcgctgaggtcctccactaccaaactcatctcccacgaatgttctgcaccagttatgtcgccccactgtttctgaaacttgatctattttaggttagtttgtggtgtagtaacacatgcatgcatacacacacacacacacacacacacacatca

SEQ ID NO: 80 - protein, 377 aa, Populus tremuloides
MDFHLKQWRNQHEESGQQPSAKMPKLLMDPHQPQQHPHSSGSAAFPLFLPEPSCKNSNLSAFPDSNTAANTRLPKIMGNYFSLEQWQELELQALIYRFMLAGAAIPPELLQPIKKTLLHSHPPPYFLHHPLQLHCSYYQPSWYWGRAAMDPEPGRCRRTDGKKWRCSRDVVAGHKYCERHLHRGRNRSRKPVENPTPTISTNITCIGIGELDQTTFSLFCFCFNLLAHPYCSSKTESKGLIGPPPPNEVGNRSDGHILWHFFDDWPRSVDESDNMNAGSSMNSLTCLSVSMPGNSPASDVSLKLSTGNNIAEEEPEPVPAPIPRGNTSNWAAAGWGTKITNQVVTSMGGPLAEALRSSTTKLISHECSAPVMSPHCF

SEQ ID NO: 81 - DNA, 1280 bp, Populus tremuloides
gcgctcgcttgtgttgtggtgacaggagaaatgacaccatctgtgaatgagagagtgctttttacagctgctcagtggcaagaacttgaaagacaaaccacgatttacaagtacatgatggcttctgttcctgtccctcctgaactccttatacccatcaccaaaaatcaatcaaatgtccttcctccacggtctaacagttcactagaactgggaattcctagcctgaactcatcagatgcagaaccatggagatgcaaaagaactgatgggaaaaaatggaggtgttcaagagatgtggcacctgaccagaaatactgtgagaggcactctcataagagccgtccccgttcaagaaagcctgtggaattacacactcatgactccccgaggacattgaccaacaataacactaacaccaacaatagcaattactccactaatccacacctgtttaatcaaaaaccttactttccaagccatttatttatgtttcctagtgccatggccccttctgccagctcatatgatcaacccaggagcttggaatggctcttgaaaggcgagattttacccgttgccagtaattacagccaagaatggcagcatttgaagagagacagcatcaagggtaatggcaaagtgtacaacgtttatggagaagagcagccgctttgctcaaatacatatagaggtggccattcattacaagctcagaggctaaatgatcattgcagcgtgttatcaagtcccaaatcaactactttggaaagggctttaagtcctagcctgacccaagaacaagagacaaggcacttcattgatgcttggtcaactaattcagggagagacgacattggtgggattggtaaaaaaagttacgtttcttcaagtgagaagttagtattgccacattcagctcttacattgtcaatgtcacctggcactggaagtgaaactaataatgaaggaaatgggagtgctcaactgagtagttttgggatcatgggattatcagatagagatcatcagagtgcgagtggcttgagacctcagtggatgatgagtcatggtggttcatggatagtatcaccacctggtggaccattagctgaagccttgtgtcttggcatttccagcaatgcaaaaactgcttccaatttaccatccccttgcagcagtagctgtggccccaattaatgtcaacaaaaaccaaccgctatagtttgttgtaaattctggctgggtagaggccagagggtagaagctaatgtggccca

SEQ ID NO: 82 - protein, 513 aa, Populus tremuloides
MRSSWSRTRSGVFVDDIGLGLRMQDNLESCSGSSKRSVTAMSCDHEPAAHELSSSSCSGGGGGSGPLFYSTSNHVTCLGDIKDVVASVSASGTGTPDAIAESKSLQYPYFISDSSPFTFNSSGEMTPSVNERVLFTAAQWQELERQTTIYKYMMASVPVPPELLIPITKNQSNVLPPRSNSSLELGIPSLNSSDAEPWRCKRTDGKKWRCSRDVAPDQKYCERHSHKSRPRSRKPVELHTHDSPRTLTNNNTNTNNSNYSTNPHLFNQKPYFPSHLFMFPSAMAPSASSYDQPRSLEWLLKGEILPVASNYSQEWQHLKRDSIKGNGKVYNVYGEEQPLCSNTYRGGHSLQAQRLNDHCSVLSSPKSTTLERALSPSLTQEQETRHFIDAWSTNSGRDDIGGIGKKSYVSSSEKLVLPHSALTLSMSPGTGSETNNEGNGSAQLSSFGIMGLSDRDHQSASGLRPQWMMSHGGSWIVSPPGGPLAEALCLGISSNAKTASNLPSPCSSSCGPN

SEQ ID NO: 83 - DNA, 1623 bp, Saccharum officinarum
ccagcatccactctctcatcagcagcctcttcttcttctcccccaaatgagtgctgagttttgtgctgctgcgggcatggagctcggagtcggggatgtgatggggctgcagcaaggcatcgccatcaccgcgccatcgcccaggggcagcggcgacctgggtcttctcaagcgagcagccctcacccaggcagcagctggcccctacccctcccccttcctcgacgaacagaagatgctcaggttctccaaggcggctcacacattgccctcagggctaggcttggattttggaggcccaagcgagcaggctttcctgctgtccaggaccaagaggccatttactccctcgcagtggatggagctggagcaccaggctctgatatacaagtatctcaatgcaaaggcccccataccttccagcctgctcatttcaatcagcaagagcttcagatcatccaatagagtgagctggaggcctctctatcaaggctacacaaatgcagactctgacccagagcctggaagatgccgacgaacagatggaaagaagtggcgatgctccaaggaggcaatggctgatcacaagtactgtgagcggcacatcaacagaaaccgtcaccgttcaagaaagcctgtggaaaaccaacccaaaaagaccaccaaggaggtgcctgctgctgctagctcattgccatgtgctgggccacaaggttgcttgaagaaggcaaaagttaatgactccaagccaggcactgtcagctgttggacagatagtttaaacaggacaatgttgagcagagagaaagcaaacaaaccgacggaggacaactctttgctgcttaattctacgaatagccagcccaccttgtccctgctctctcaactgaagcagcagaacaaaccagataagttaggtcccacactggaaaatgagtcaaactcagacacaatactgaaagcctggggtggcaaccagcctagccacaagagcatttcctccacacagcaccatgatgctgaatccctccaatcagtccttcaaaatttcagcctagcccagaatgagaagatggagtcagaaaagaacaaatattctgattccatgctagtttcatcgactttctattctgcagacggtccacgatctacctgccttacacctaacatgacacaagtgcagcaggattgcatatcaagctcttgggagatgcctcaaggtggacctctaggcgagatcttaaccaactccaagaatagtgaggacttaagcaagtgtgaatcaaggtcatatggttggttattgaatcttgaccatgcaccatgattcctcaatccatggagagcttgacatagatgtctcaccatggaagcaaacaatggtcagaaaaagaaggttcaaatgaccacattgtttgccccatgcatgctcgctatctacatttgtatttctgttttgtagcatttagctagttgaattatcagttcttctgaatctggctgtattttaaacaaattctagtttgtgtcagatgatatcttgcttgctagatgtttcatgtctaactttcaacaggaacttcagagatccattttgatcaacagaaaactgtttgaagaacc

SEQ ID NO: 84 - protein, 426 aa, Saccharum officinarum
MSAEFCAAAGMELGVGDVMGLQQGIAITAPSPRGSGDLGLLKRAALTQAAAGPYPSPFLDEQKMLRFSKAAHTLPSGLGLDFGGPSEQAFLLSRTKRPFTPSQWMELEHQALIYKYLNAKAPIPSSLLISISKSFRSSNRVSWRPLYQGYTNADSDPEPGRCRRTDGKKWRCSKEAMADHKYCERHINRNRHRSRKPVENQPKKTTKEVPAAASSLPCAGPQGCLKKAKVNDSKPGTVSCWTDSLNRTMLSREKANKPTEDNSLLLNSTNSQPTLSLLSQLKQQNKPDKLGPTLENESNSDTILKAWGGNQPSHKSISSTQHHDAESLQSVLQNFSLAQNEKMESEKNKYSDSMLVSSTFYSADGPRSTCLTPNMTQVQQDCISSSWEMPQGGPLGEILTNSKNSEDLSKCESRSYGWLLNLDHAP

SEQ ID NO: 85 - DNA, 1515 bp, Vitis vinifera
atgatgatgagtgcaagaaacaggtctcctttcacagcatcacagtggcaagagcttgaacatcaagctcttatcttcaaatatatagtgtcaggagtaccaatcccagctgatctcatctgcactgtcaaaagaagcttggactcttcattgtcttcaaggctatttcctcaccaacccattgggtggggttgttttcagatggggtttggcaggaaagcagacccagagccagggaggtgcagaagaactgatggcaagaaatggaggtgctccaaagaagcatacccagattcaaaatactgtgagagacacatgcacagaggcaaaaaccgttcaagaaagcctgtggaagttatttcagctacaaacccttcaccaaccatctcatcaatcaactcaaatccttcctccaccaccaccaattcttactctctctctcctctctctcctctctcttcttcaatgacttctgaaacctcccatccccatcaccattcctaccacaacacctctctttatcccttcctctaccctcacccctcctcttctagacctcctggttcttgcctatcacctcaagccaccagcagttacagcacccatcatctgtttttggactctgggtcttattcccaggctgatagggattacaggggtgtggatgagagagctttcttcccagaagcttcagggactgtaaggggcctacatgattcatatactccattaacaatgagttcctccaagggatactctcactttcagtatcaaagccccgctgataatcccaaacagcagcaagaacagcaagagcagcagcactgctttgtcttgggcactgatttcaaatcgtcaaggccaattaaagtagagagagatgatgaagcccagaagcctctccaccatttctttggagagtggcctctaaagaacagagactcctggcttgaccttgaggaggatccaccaacccatgcatcattctccaccacccagctctcaatttcaatcccaatgtcctcacacaagcttcttgcatcggattccagaatccaaactggtacttagacttcacttcagatttggccttcttgccctttattttcccttttctgctaagtctcatcttctacttcatttttcccccttgtgcagatggatgagttctcaatactggttcttctgatcatggccaaaaaagtacttgtactggtgggttcaatgcttttcttgttgattttgtgactgaaggaagtttcttttgccaaatgtgcggatgaataatgtagggcctataggaggattcttgtctttgtgctttctgagttgctaattttcattcttatctttaaagaaacatgtttgaatttgtagacttgtttgtttgacaggaagcatcttgatatggtttttgagtttgagtttgagttgttctctaatctctatgttgttttgtgagttgtggccaccttttcttttccctttggcttctgcttattgtacttcagaaag

SEQ ID NO: 86 - protein, 356 aa, Vitis vinifera
MMMSARNRSPFTASQWQELEHQALIFKYIVSGVPIPADLICTVKRSLDSSLSSRLFPHQPIGWGCFQMGFGRKADPEPGRCRRTDGKKWRCSKEAYPDSKYCERHMHRGKNRSRKPVEVISATNPSPTISSINSNPSSTTTNSYSLSPLSPLSSSMTSETSHPHHHSYHNTSLYPFLYPHPSSSRPPGSCLSPQATSSYSTHHLFLDSGSYSQADRDYRGVDERAFFPEASGTVRGLHDSYTPLTMSSSKGYSHFQYQSPADNPKQQQEQQEQQHCFVLGTDFKSSRPIKVERDDEAQKPLHHFFGEWPLKNRDSWLDLEEDPPTHASFSTTQLSISIPMSSHKLLASDSRIQTGT

SEQ ID NO: 87 - DNA, 945 bp, Zea mays
agagcgccgtatcacctgtctctccgtccaccgccgtctcgatccgcgccaaagatacctttcccccaccccttcctcgcgccgccgtttggtgcgaccatgacggcggagggggaggccaagaacccgtcggccggtggcggaggggataacccccagcaccagcaggctgcgccggcgccggcgccggcacagggggaagtggcgcaggaggctgcagtgcaggggacgggacaagagcaggagcgggacaaggcggatcgagaggtgcagggcggcgcgggggagaaggacgacggcgcgtgcagagatctggtcctggtcgaggatccggaggtcctcgccgtcgaggatccggaggaagctgcagcaaccgcagcactccaggaagaaatgaaagcgcttgtggcatcgatccctgatggtgctggagcagcattcacagccatgcagcttcaggagctagagcagcagtcccgggtgtaccagtacatggctgcccgagtacctgtgcctactcacctcgtcttcccggtatggaagagtgtgaccggtgcatcctctgaaggcgcccagaagtaccctactttgatgggcttagcaacgctctgcttggactttgggaagaacccggaaccagaaccagggaggtgtcggcgaacagatggtaagaaatggcgatgttggagaaacactatcccaaacgagaaatactgcgaacgtcacatgcatcgtggccgcaagcgtcctgtacaggttttcctggaggacgacgagcccgattctgcttcagggtcaaaacccgccgctcctggcaaggctaccgaaggtgccaagaaggccgatgacaagagcccaagcagcaagaagcttgcagtggcagcgcctgccgctgtgcagtctacatagtcaattgcagctttagtagcccgcagaaagagcata

SEQ ID NO: 88 - protein, 269 aa, Zea mays
MTAEGEAKNPSAGGGGDNPQHQQAAPAPAPAQGEVAQEAAVQGTGQEQERDKADREVQGGAGEKDDGACRDLVLVEDPEVLAVEDPEEAAATAALQEEMKALVASIPDGAGAAFTAMQLQELEQQSRVYQYMAARVPVPTHLVFPVWKSVTGASSEGAQKYPTLMGLATLCLDFGKNPEPEPGRCRRTDGKKWRCWRNTIPNEKYCERHMHRGRKRPVQVFLEDDEPDSASGSKPAAPGKATEGAKKADDKSPSSKKLAVAAPAAVQST

SEQ ID NO: 89 - DNA, 1372 bp, Zea mays
gcctctgacaccagcacaaacctggagactactactagtattggagtcccctccacttccacctcccttgccactgaagcgagagctctcggagccgtcgtcctctgtctctcatccttcttcgttgttgagcaaagcgggctcgaggaggagatgatgctgagcgggcacggcggcgggaggcgcctgttcacggcgtcgcagtggcaggagctggagcaccaggcgctcatcttcaaatacatggcctccggcgcgcccgtgccgcacgacctcgtcctgccgctccgcctcgccaccggcgtcgacaccgcgccctccctcgccttcccgccccagccttcgccgtcgctggcgtactggggctgctatggcgcgggggcgccgttcggccgcaaggcggaggacccggagcccgggcggtgccggcggacggacggcaagaagtggcgatgctccagggaggcccacggagactccaagtactgcgagaagcacatccaccgcgggaagagccgttcaagaaagcctgtggaagtgacctcccccgccgcctaccgcccgtccgcgttctccatctcgccgcctcgcgcggccgacgcgccgccgccgccgccgggcctcggccacccgcagcagcagcatctccgccacggcgctctctctccagcaggccgcgcccacgccgctggcgctctccagctccacctcgactcgagcctgcacgcggcgtcgccgccgccgtcctaccacaggtacgcccactcccacgctcactacacgccgccgccgccgccgtcgctctacgactacgggcagtccaaggagcttcgggaggcggcggagctcaggcggcggcacttccacgcgctcggggccgacctgagcctcgacaagccgctggccgacgccggggccgcggagaagcccctgcggcgtttcttcgacgagtggccgcgggagagaggcgacacgaggccgtcgtgggcgggggcggaggacgcgacgcagctctccatctccatccccgcggcttcgccctcctctgaccacgctgcctctgccgccgcgcgatgccacaacgatgggagtgatcggtgcatctcctagctgcaactgcaatgcaagcctgcaaccgcgtggattgttgttgattggtgtagtttcctagctgcaattcaagcctgcaacagcgagcagtgagcagcaaatgcgtggggagggcacgcagctcaggctgatgcgcaaaatccgaagcgagtcaagcagcaataggactctaggtctatgatttgatcttcctttgtagcagtacgttaccaaaatgttagctcgttgttgttcggtgtgacattttcgttcaggttgctcc

SEQ ID NO: 90 - protein, 318 aa, Zea mays
MMLSGHGGGRRLFTASQWQELEHQALIFKYMASGAPVPHDLVLPLRLATGVDTAPSLAFPPQPSPSLAYWGCYGAGAPFGRKAEDPEPGRCRRTDGKKWRCSREAHGDSKYCEKHIHRGKSRSRKPVEVTSPAAYRPSAFSISPPRAADAPPPPPGLGHPQQQHLRHGALSPAGRAHAAGALQLHLDSSLHAASPPPSYHRYAHSHAHYTPPPPPSLYDYGQSKELREAAELRRRHFHALGADLSLDKPLADAGAAEKPLRRFFDEWPRERGDTRPSWAGAEDATQLSISIPAASPSSDHAASAAARCHNDGSDRCIS

SEQ ID NO: 91 - DNA, 1099 bp, Zea mays
cgcatccgttctctatcgaaagggaggaggaggagcgcgcgggagtgggctgggggcccaccgatgctgagctcggcgtcctcggccggggcggccatggggatgggcggcgggtaccaacaccagccgctgccactgccgcagcgcggggcggcggccgcggtcttcaccgccgcgcagtgggcggagctggagcagcaggcgctcatctacaagtacctcatggccggcgtccccgtcccgcccgatctcctccgccccgccccccacgccgccgccttctccttcgccagccccgccgcgtcgcccttctaccatcaccaccaccaccacccgtccctgagttactacgcctactacgggaagaagctggacccggagccgtggcggtgccgccgcaccgacggcaagaagtggcggtgctccaaggaggcgcaccccgactccaagtactgcgagcgccacatgcaccgtggccgcaaccgttcaagaaagcctgtggaatccaagaccgcctcctcgccgccccagctgtccaccgtcgtcaccaccaccaccacccgggaggccgccgccgcgacgcccctcgagtccctcgcgggggcggggggtaaggctcacggcctgtccctcggcggcggggctggctcgtcgcacctcagcgtcgacgcttcgaacactcactttcgctatggcagcaagtaccctcttggagctaaatccgatgctggcgagctgagcttcttctcaggagcaccagggaactccaggggcttcaccattgattctccagcagataactcttggcactccctgccatccaacgtgcccccgtttacactgtccaagggcagagattctggcctcctgcctggagcgccaccagtcgtcgttcagcagcagcggggccggcgctggtgggttgctggggagcgtgaagcaggagaaccagccgctgaggcccttcttcgacgagtggcctgggacgcgggactcgtggtcggagatggacgacgcgaggtccagtaggacctccttctcgacgacccagctctccatctccattccgatgcccagatgtgattgagaacgaagctcg

SEQ ID NO: 92 - protein, 321 aa, Zea mays
MLSSASSAGAAMGMGGGYQHQPLPLPQRGAAAAVFTAAQWAELEQQALIYKYLMAGVPVPPDLLRPAPHAAAFSFASPAASPFYHHHHHHPSLSYYAYYGKKLDPEPWRCRRTDGKKWRCSKEAHPDSKYCERHMHRGRNRSRKPVESKTASSPPQLSTVVTTTTTREAAAATPLESLAGAGGKAHGLSLGGGAGSSHLSVDASNTHFRYGSKYPLGAKSDAGELSFFSGAPGNSRGFTIDSPADNSWHSLPSNVPPFTLSKGRDSGLLPGAPPVVVQQQRGRRWWVAGEREAGEPAAEALLRRVAWDAGLVVGDGRREVQ

SEQ ID NO: 93 - DNA, 1328 bp, Zea mays
cctcccgtcagcctcttcttctccccctgatgagcgctgagttctgtgctgccgccgctggtgctgtggccatggagctcggagtcggggatgtgatggggctgcagcaaggcatcgccgccgccaccgggccatcgtccggagacagcgacctgggtcttctcaagcgagcaggcctcgcccaggcagccacctcctacccctcccctttcctcgaccaacagaagatgctcaggttctccaaggcggcggcggctcacacgtcgccctcaggcctagatttcggaggaggcccaagcgagcaggctttcctgctgtccaggaccaagcggccgttcaccccgtcgcagtggatggagctggagcaccaggctctcatatacaagtatctcaatgccaaggcccccataccttccagcctgctcgtttccatcagcaagagcttcaggtcatccaacagagtgagctggaggcctctttaccaaggctacgcaaacgcagactccgacccagaacctgggaggtgccggcggacagacggaaagaagtggcggtgctctaaggaggcgatgcctgatcacaagtactgcgagcgccacatcaataggaaccgccaccgttcaagaaagcctgtggaaaaccaacctagaaagaccagcaaggaggtgcctaccgctgctgctggctcgttgccgtgtgccgggccacaaggtagcttgaagaaggcaaaagttaatgactccaagccaggcactggcagctattggacagatagcttaaacaggacaatgctgagcagggagaaggcaaacaaaccgacggaagacgagtctttgctgcttagttctacgaagaacagccagcccaccttgtccctgctcactcaactgaagcagcagaacaaaccagataagttaggtcccacaccggaaaatgagccgaactcggacacaatgttgaaagcctggggtggcagccaccacaagaacatttcctccacacagcgccatgacgctgaatccctccaatcagtcctccaaaatttcagcctagcccagaatgacaggttggagtcagaaaagaacagatattctgattccgtgctagtctcatcggctttctattctgcagacggtccacaaactacctgccttacacctaacatgacacaagtgcagcaggactgcatatcaagctcctgggagatgcctcaaggtggacctctaggcgagatcttaacgaactccaagattagtgaggactcaagcaagtgtggatctaggtcatatggttggctattgaatcttgaccatgcaccatgattcctc

SEQ ID NO: 94 - protein, 430 aa, Zea mays
MSAEFCAAAAGAVAMELGVGDVMGLQQGIAAATGPSSGDSDLGLLKRAGLAQAATSYPSPFLDQQKMLRFSKAAAAHTSPSGLDFGGGPSEQAFLLSRTKRPFTPSQWMELEHQALIYKYLNAKAPIPSSLLVSISKSFRSSNRVSWRPLYQGYANADSDPEPGRCRRTDGKKWRCSKEAMPDHKYCERHINRNRHRSRKPVENQPRKTSKEVPTAAAGSLPCAGPQGSLKKAKVNDSKPGTGSYWTDSLNRTMLSREKANKPTEDESLLLSSTKNSQPTLSLLTQLKQQNKPDKLGPTPENEPNSDTMLKAWGGSHHKNISSTQRHDAESLQSVLQNFSLAQNDRLESEKNRYSDSVLVSSAFYSADGPQTTCLTPNMTQVQQDCISSSWEMPQGGPLGEILTNSKISEDSSKCGSRSYGWLLNLDHAP

SEQ ID NO: 95 - DNA, 1440 bp, Zea mays
gccaccaagagccctccaacacacacctgacctccccttcccccctctctccgccgcccgttccccgcgcctccgcccgtacgtcccgttcccggtcggccggccggtccaaagggaggggaggaggaggggcgcgggagtcggggcccgcaccgatgctgagctcggcatcctcggccgcgggggcggccatggggatgggcggcggcgggtacgcgcaccagcccccgccacagcgcgcggtcttcaccgccgcgcagtgggcggagctggagcagcaggcgctcatctacaagtacctcatggccggcgtccccgtcccgcccgacctcctcctccccgtccgccccggccccgccgccgccttctccttcgccggccccgccgccgcgtcgcccttctaccaccaacaccacccgtccctgagctactacgcctactacggcaagaagctggacccggagccgtggcggtgccgccgcaccgacggcaagaagtggcggtgctccaaggaggcgcaccccgactccaagtactgcgagcgccacatgcaccgtggccgcaaccgttcaagaaagcctgtggaatccaagaccgcctcgtcgtcgtcgcccgcgcacccgtcgccgccccagctgtccaccgtcaccaccaccgcgcctctcgagccccttgcagcggcggggggcaaggtccacggcctgtccctcggcggcggcgctgctggctcgtcgcacctcggcgtcgatgcttcgaatgctcactatcgttatggtagcaacaggtaccctctcggagctaaaccggacggcggcgagttgagcttcttctcaggagcgtcatcggggaacaactcgaggggtggcttcaccatcgactctccatcagataacaactcgtggcactccgccctggcgtccagcgtgcccccgttcacgctgtcgacgaagagcggggactccggcctcctgcccggcgcctacgcctcctactcccagtcccactcccacatggagccgccgcgggagctcgggcaggtcaccatcgcctcgctggcgcaggagcaggagcgccagcagccgttcagtggtgggatgctcgggaacgtgaagcaggagaaccagaaccagccgctgcggcccttcttcgacgagtggcccgggacgcgggcggactcgtggccgccggagatggacggcgcgccgcgggccggcaggacctccttctcctcctccaccacccagctctccatctccatcccgatgcccagatgtgagctgcatctcagaaaccagaactcttaattctgttcgctgcccgaatcatgcttgaccgaaacttgttttctgcaggcgactgacgaggaaccgtcgatcgggcggccactagacggtggacgctcacgctcactagtgcgctgtcgcctggagtggagatcga

SEQ ID NO: 96 - protein, 382 aa, Zea mays
MLSSASSAAGAAMGMGGGGYAHQPPPQRAVFTAAQWAELEQQALIYKYLMAGVPVPPDLLLPVRPGPAAAFSFAGPAAASPFYHQHHPSLSYYAYYGKKLDPEPWRCRRTDGKKWRCSKEAHPDSKYCERHMHRGRNRSRKPVESKTASSSSPAHPSPPQLSTVTTTAPLEPLAAAGGKVHGLSLGGGAAGSSHLGVDASNAHYRYGSNRYPLGAKPDGGELSFFSGASSGNNSRGGFTIDSPSDNNSWHSALASSVPPFTLSTKSGDSGLLPGAYASYSQSHSHMEPPRELGQVTIASLAQEQERQQPFSGGMLGNVKQENQNQPLRPFFDEWPGTRADSWPPEMDGAPRAGRTSFSSSTTQLSISIPMPRCELHLRNQNS

SEQ ID NO: 97 - DNA, 1388 bp, Zea mays
gacaggttgagatggcgatgccgtatgcctctctttccccggcaggcgccgccgaccaccgctcctccacagccacggcgtccctcgtccccttctgccgctccaccccgctctccgcgggcggcgggctgggggaggaggacgcccaggcgagcgcgaggtggccggccgcgaggccggtggtgccgttcacgccggcgcagtaccaggagctggagcagcaggcgctcatatacaagtacctggtggccggcgtgcccgttccgccggatctcgtggttccaatccgccgcggcctcgactccctcgctacccgcttctacggccaacccacactcgggtacggaccgtacctggggaggaaactggatccggagcccggccggtgccggcgaacggacggcaagaagtggcggtgctccaaggaagccgccccggactccaagtactgcgagcgccacatgcaccgcggccgcaaccgttcaagaaagcctgtggaaacgcagctcgcgccccagtcccaaccgcccgccgccgcggccgtctccgccgctccgcccctggcagccgccgccgccgccgccaccaacggcagcggcttccagaaccactctctctacccggccatcgccggcagcactggtggtggaggaggagttggcgggtccggcaatatctcctccccgttctcctcgtcgatggggggatcgtctcagctgcacatggacagtgttgccagctactcctacgcagctcttggtggtggaactgcaaaggatctcaggtacaacgcttacggaataagatctctggcggacgagcacaaccagctgatcgcagaagccatcgactcgtcgatagagagccagaggcgcctccccagctcgtcgttcccgctctcgagctacccacatctcggggcgctgggcgacctgggcggccagaacagcacggtgagctcgctgccgaagatggagaagcagcagccgccctcgtccttcctagggaacgacaccggggccggcatggccatgggctccgcctccgcgaagcaggagggccagacgctgcggcacttcttcgacgagtggcccaaggcgcgggactcctggccgggcctctccgacgagaccgccagcctcgcctcgtcccccccggcgacccagctgtcgatgtccatacccatggcgtcctccgacttctccgtggccagctcccagtcgcccaacgatgactaatggtgcgtggatcgtcgcgttctggccctttgtctatctcccctccagtcctccacccaccgcgcagtagtagctgcggaaacagcccatgctcctgtatatttgtcggtcattttccgtgtcagatctgtgtaccaaaccaagcggcgg

SEQ ID NO: 98 - protein, 408 aa, Zea mays
MAMPYASLSPAGAADHRSSTATASLVPFCRSTPLSAGGGLGEEDAQASARWPAARPVVPFTPAQYQELEQQALIYKYLVAGVPVPPDLVVPIRRGLDSLATRFYGQPTLGYGPYLGRKLDPEPGRCRRTDGKKWRCSKEAAPDSKYCERHMHRGRNRSRKPVETQLAPQSQPPAAAAVSAAPPLAAAAAAATNGSGFQNHSLYPAIAGSTGGGGGVGGSGNISSPFSSSMGGSSQLHMDSVASYSYAALGGGTAKDLRYNAYGIRSLADEHNQLIAEAIDSSIESQRRLPSSSFPLSSYPHLGALGDLGGQNSTVSSLPKMEKQQPPSSFLGNDTGAGMAMGSASAKQEGQTLRHFFDEWPKARDSWPGLSDETASLASSPPATQLSMSIPMASSDFSVASSQSPNDD

SEQ ID NO: 99 - DNA, 1506 bp, Zea mays
ccatctggccatctccccttcccctgctcccccgaagcagcaagccagcctgcccacccgcagccatcacctccgccgctctccaccatgaatcccatccaccagcacgacatcgtacccaatccttcgtgactgttgcctccgcgcatctccgggagcaatggaaggaggccgagatgtgttcttaggtgcggcggcaagggcgccgccgccgccgccgtcttgcccgtttcacggatccgctaccgccacccgctccggtggagcgcagatgctcagcttctcctccaatggcgtagcagggttgggtctgtgctcaggtgccagcaagatgcagggtgtgttgtcgagggtgaggaggcccttcactccgacgcagtggatggagctggagcaccaggccctgatctacaagcacttcgctgtgaatgcccctgtgccgtccagcttgctcctccctatcaaaagaagcctcaatccatggagcagccttggctccagctcattgggatgggcaccatttcgttccggctctgctgatgcagaaccaggaagatgccgccgcacagatggcaagaagtggcggtgctctagagatgctgtcggggaccaaaaatactgtgagcgatacataaaacgtggttgccaccgttcaagaaagcatgtggaaggccgaaaggcaacaccgaccactgcagatccaaccatggctgtttctggtggttcattgttgcacagccatgctgttgcttggcagcagcagggcaaaagctcagctgctaatgtgactgatccattctcactagggtccaacaggaatttgctggataagcagaatctaggtgaccagttctctgtatccacttccatggactcctttgacttctcatcatcacattcttccccaaaccaagccaaagttgcattttcaccggtggccatgcagcacgaacatgatcagctgtatcttgtgcatggagccggcagctcagcagaaaacgttaacaagtctcaggatggtcagctgctagtctcgagggaaacaattgacgacggacctctgggcgaggtgttcaagggcaagagttgccagtcagcatccgcagacatcttaactgaccattggacttcgactcgtgacttgcgtcctccaaccggagtcctacaaatgtctagcagcaacacagtgccagcagagaatcacacgagtaacagtagctatctcatggcgaggatggcgaattctcagaccgtcccaacactccactgagtgttcatcaggctggtctttgttgggaccacaaaataactgaagccatgttgatgtcctgagtttgctgatacagtgatactaggttttcagtcgagtcttgtaactcctgttttagagttgttatatgttcacgtcatgttgcctttcattttcggtttcattcagatgggtgtactaataatttctttccttcttacctgtgaaggatttgagttccaatctgagacgtgggt

SEQ ID NO: 100 - protein, 369 aa, Zea mays
MEGGRDVFLGAAARAPPPPPSCPFHGSATATRSGGAQMLSFSSNGVAGLGLCSGASKMQGVLSRVRRPFTPTQWMELEHQALIYKHFAVNAPVPSSLLLPIKRSLNPWSSLGSSSLGWAPFRSGSADAEPGRCRRTDGKKWRCSRDAVGDQKYCERYIKRGCHRSRKHVEGRKATPTTADPTMAVSGGSLLHSHAVAWQQQGKSSAANVTDPFSLGSNRNLLDKQNLGDQFSVSTSMDSFDFSSSHSSPNQAKVAFSPVAMQHEHDQLYLVHGAGSSAENVNKSQDGQLLVSRETIDDGPLGEVFKGKSCQSASADILTDHWTSTRDLRPPTGVLQMSSSNTVPAENHTSNSSYLMARMANSQTVPTLH

SEQ ID NO: 101 - DNA, 1350 bp, Zea mays
tagccgtgctccgctcaccttctctcgcgctacagtctcaaggggtagctagccaagctaccaagctcgtcaggaacgagagaaagaggccggcggtgcgcggggatgatgatgatgagcagcggccgggcgggcggcggggccaccgcggggcggtacccgttcacggcgtcgcagtggcaggagctggagcaccaggcgctcatctacaagtgcctggcgtccggcaagcccatcccttcctacctcatgccgccgctccgccgcatcctcgactccgccctcgccacgtcgccgtccctcgcctacccgccgcaaccctcgctgggctggggctgcttcgggatgggcttcacccggaaggccgacgaggacccggagcccgggcggtgccggcgcacggacggcaagaagtggcgctgctccaaggaggcgtacccggactccaagtactgcgagaagcacatgcaccggggcaagaaccgttcaagaaagcctgtggaaatgtccttggccacgccggccccggcgccggcccccgccgccgccacaaccgccaccgccacctcatccccggcgccgtcctaccaccgcccggcccacgacgccacgccgtctccgtaccacgcgctgtatggaggcggcggcggcggcggcggtagcccttactcggcgtcggcacgcccaggagcaaccggaggcggcggcgcgtaccaccacgcgcagcatgtgagccccttccacctccacctcgagaccacccacccgcacccgccgccgccctacaactactccgccgaccagagggactacgcgtacgggcacgcggccgccaaggaggtcggcgagcacgccttcttctcggacggcgcgggcgagcgggtcgaccgccaggccgcggcggggcagtggcagttcaggcagctcggggtggagacgaagccgggccccacgccgctgttccccgtcgccgggtacgggcacggcgcggcgtcgccgtacggcgtcgagctgggcaaggacgacgacgagcaggaggagaggcgccgccagcactgcttcgttcttggagccgacctgcggctggagcggccgtcgtcgggccatggccatggccatggccatgaccatgacgacgccgccgccgcgcagaagccgctccggcccttcttcgacgagtggccgcaccagaagggggacaaggccgggtcgtggatggggctcgacggcgagacgcagctctccatgtccatccccatggccgctaccgacctccccgtcacctcccgcttccgtaacgacgagtgatgccacatcaaacctggcgctggaaactcggaacgtatggtg

SEQ ID NO: 102 - protein, 400 aa, Zea mays
MMMMSSGRAGGGATAGRYPFTASQWQELEHQALIYKCLASGKPIPSYLMPPLRRILDSALATSPSLAYPPQPSLGWGCFGMGFTRKADEDPEPGRCRRTDGKKWRCSKEAYPDSKYCEKHMHRGKNRSRKPVEMSLATPAPAPAPAAATTATATSSPAPSYHRPAHDATPSPYHALYGGGGGGGGSPYSASARPGATGGGGAYHHAQHVSPFHLHLETTHPHPPPPYNYSADQRDYAYGHAAAKEVGEHAFFSDGAGERVDRQAAAGQWQFRQLGVETKPGPTPLFPVAGYGHGAASPYGVELGKDDDEQEERRRQHCFVLGADLRLERPSSGHGHGHGHDHDDAAAAQKPLRPFFDEWPHQKGDKAGSWMGLDGETQLSMSIPMAATDLPVTSRFRNDE

SEQ ID NO: 103 - DNA, 1028 bp, Zea mays
tcccttcaccgctgcctcgacccgcgccgaaagatacctttcccccccttcctctcgcgccgccgttttggtgcgaccatggcggcggagggggaggccaagaacccgtccggcggtggcgaagggggtaacccccagcaccagcaggcagtgcaggctgcgccggcggagccgccaatggcacagggggaagcggtgcaggaggctggagcgcaggcgacgggacaagagccggagggggagaaggcgaatcgagatggggagggaagcgcgggggagaaggacgacggcgcgtgcagagatctggttctggttgaggatccggaggtgctcgccgtcgaggacccggaggaagctgcagcaaccgcagcactccaggaagaaatgaaagcgctcgtggcatccgtccctgacggtgctggggcagcattcacagccatgcagcttcaggagctagagcagcagtcccgggtttatcagtacatggctgcccgagtacctgtgcctactcacctcgtcttccccgtatggaagagtgtaaccggtgcatcctctgaaggcgcccagaagtaccctactttgttgggcttagcaacactctgcttggacttcgggaagaaccctgaaccagaaccagggaggtgccggcgaacggatggcaaaaaatggcgatgttggagaaacactattccaaacgagaagtactgcgaacgccgcatgcatcgcggtcgcaagcgtcctgtacaggtcgtcgaggaagccgagcctgactctgcttcaggctcaaaatctgctcccggcaaggccaccgaaggcgccaagaaggttggcgacaagagcccaggtagcaagaagcttgccgtggcggcggcagctgcagctgctgcgcagtctacgtaattgatgcagcattttagtagtcgcaggaagagcatggcggcgctggcaactagcgccttcttttcattgcatgtgatctttagctataacctcatttagcacactcccagtggtgtccgtgggaggag

SEQ ID NO: 104 - protein, 273 aa, Zea mays
MAAEGEAKNPSGGGEGGNPQHQQAVQAAPAEPPMAQGEAVQEAGAQATGQEPEGEKANRDGEGSAGEKDDGACRDLVLVEDPEVLAVEDPEEAAATAALQEEMKALVASVPDGAGAAFTAMQLQELEQQSRVYQYMAARVPVPTHLVFPVWKSVTGASSEGAQKYPTLLGLATLCLDFGKNPEPEPGRCRRTDGKKWRCWRNTIPNEKYCERRMHRGRKRPVQVVEEAEPDSASGSKSAPGKATEGAKKVGDKSPGSKKLAVAAAAAAAAQST

SEQ ID NO: 105 - DNA, 1374 bp, Zea mays
cagccaggtaaggcaaaagagagagggcggaagcagcggcagagcggagagggagagagaagagcatatatgggcatggcgatgccctttgcctccccgtctccggcagccgaccaccgcccctcctccctcctccccttctgccgcgccgcccctctctccgcggcgggagaggacgccgcgcagcagcacgcgatgagcggcaggtgggccgcgaggccggcgctcttcacggcggcgcagtacgaggagctggagcaccaggcgctcatatacaagtacctcgtcgccggcgtgcccgtcccgccggacctcctcctccccctgcgccgaggcttcgtcttccaccagccacccgcccttgggtacggcccctacttcggcaagaaggtggacccggagcccgggcggtgccggcgtacggacggcaagaagtggcggtgctccaaggaggccgccccggactccaagtactgcgagcgccacatgcaccgcggccgcaaccgttcaagaaagcctgtggaagcgcagctcgcgcccccgccgcacgcccagccgccgcagcagcagcaggcccccgcgcccgctgctggcttccagaaccactcgctgtacccgtcgatcctcaacggcaacggcggcggcgggttaggtgctggtgctggtggtggcacgttcggcctggggcccacctctcagctgcacatggacagtgccgctgcctacgcgactgctgccggtggagggagcaaatatctcaggtactctgcatacggggtgaaatctctgtcggacgagcacagcacgctcttgtcgggcggcatggatccgtcgatgatggacaactcgtggcgccttctgccatcccaaaacaacacattccaagccacaagctaccctgtgttcggcacgctgagtgggctagacgagagcaccatcgcgtcgctgccgaagacccagagggagcccctctctttcttcgggagcgacttcgtgaccgccgccaagcaggagaaccagacgctgcgccctttcttcgacgagtggcccaagtcgagggactcgtggccggagctgggcgaggacggcagcctcggcttctcggccacccagctctccatctccattcccatggcgacctccgacttctccaacaccagctccagatcgccgggtggaataccgtcgagatgaacgagtaccgtgcatgtggatcccagcgtcttagggttgacgactcttcggtgctggcctcatcgtatcatgctcctaaattttcgaacgatatatgccttatgtaacgctatttctctcattgttacaacaccctttacccgtttggaattgtgttgaagtggatggtctgcgttgctc

SEQ ID NO: 106 - protein, 374 aa, Zea mays
MGMAMPFASPSPAADHRPSSLLPFCRAAPLSAAGEDAAQQHAMSGRWAARPALFTAAQYEELEHQALIYKYLVAGVPVPPDLLLPLRRGFVFHQPPALGYGPYFGKKVDPEPGRCRRTDGKKWRCSKEAAPDSKYCERHMHRGRNRSRKPVEAQLAPPPHAQPPQQQQAPAPAAGFQNHSLYPSILNGNGGGGLGAGAGGGTFGLGPTSQLHMDSAAAYATAAGGGSKYLRYSAYGVKSLSDEHSTLLSGGMDPSMMDNSWRLLPSQNNTFQATSYPVFGTLSGLDESTIASLPKTQREPLSFFGSDFVTAAKQENQTLRPFFDEWPKSRDSWPELGEDGSLGFSATQLSISIPMATSDFSNTSSRSPGGIPSR

SEQ ID NO: 107 - DNA, 1172 bp, Zea mays
gatatatggcgatgccctttgcctccctgtctccggcagccgaccaccgcccctcctccctcctcccctactgccgcgccgcccctctctccgcggtgggagaggacgccgccgcgcaggcgcagcagcagcagcagcagcacgctatgagcggcaggtgggcagcgaggccgccggcgctcttcacagcggcgcagtacgaggagctggagcaccaggcgctcatatacaagtacctcgtcgccggcgtgcccgtcccgccggacctcctcctccccctacgccgaggcttcgtctaccaccaacccgcccttgggtacgggccctacttcggcaagaaggtggacccggagcccgggcggtgccggcgtacggacggcaagaagtggcggtgctccaaggaggccgccccggactccaagtactgcgagcgccacatgcaccgcggccgcaaccgttcaagaaagcctgtggaagcgcagctcgtgcccccgccgcacgcccagccgcagcagcaggcccccgcgcccaccgctggcttccagagccaccccatgtacccatccatcctcgccggcaacggcggcggcggcggcggggtaggtggcggtgctggcggtggcacgttcggcctgggccccacctctcagctgcgcatggacagtgccgctgcttacgcgactgctgctgatggagggagcaaagatctcaggtactctgcctacggggtgaagtcactgtcggacgagcacagccagctcttgcccggcggcggcggcggcatggacgcgtcaatggacaactcgtggcgcctgttgccgtcccaaaccgccgccacgttccaagccacaagctaccctctgttcggcgcgctgagcggtctggacgagagcaccatcgcctcgctgcccaagacgcagagggagcccctctccttcttcgggagcgacttcgtgaccccgaagcaggagaaccagacgctgcgccccttcttcgacgagtggcccaagtcgagggactcgtggccggagctgaacgaggacaacagcctcggctcctcggccacccagctctccacctccatccccatggcgccctccgacttcaacaccagctccagatcgccgaatggaataccgtcaagatgaacctgagtaaccatgcggacccca

SEQ ID NO: 108 - protein, 380 aa, Zea mays
MAMPFASLSPAADHRPSSLLPYCRAAPLSAVGEDAAAQAQQQQQQHAMSGRWAARPPALFTAAQYEELEHQALIYKYLVAGVPVPPDLLLPLRRGFVYHQPALGYGPYFGKKVDPEPGRCRRTDGKKWRCSKEAAPDSKYCERHMHRGRNRSRKPVEAQLVPPPHAQPQQQAPAPTAGFQSHPMYPSILAGNGGGGGGVGGGAGGGTFGLGPTSQLRMDSAAAYATAADGGSKDLRYSAYGVKSLSDEHSQLLPGGGGGMDASMDNSWRLLPSQTAATFQATSYPLFGALSGLDESTIASLPKTQREPLSFFGSDFVTPKQENQTLRPFFDEWPKSRDSWPELNEDNSLGSSATQLSTSIPMAPSDFNTSSRSPNGIPSR

SEQ ID NO: 109 - DNA, 1154 bp, Zea mays
agcgtgcattgttgagcgagtgcggccaagcaacgcgggctcgaggagatgatgctgagcgggcacggcggcgggaggcgcctgttcacggcgtcgcagtggcaggagctcgagcaccaggcgctcatcttcaagtacatggcctcgggcgcgcccgtgccgcacgacctcgtcctaccgctccgcctcgccaccggcgtcgacaccgcgccctccctcgccttcccgccccagccttcgccgtcgctggcgtactggggctgctacggcgcgggggcgccgttcgtcggccgcaaggcggcggaggacacggagccggggcggtgccggcggacggacggcaagaagtggcggtgctccagggaggcccacggcgactccaagtactgcgagaagcacattcaccgcgggaagagccgttcaagaaagcctgtggaagtgacctcctcccccgccgccggcgccgctgcggcgtaccgaccgtccgcgatctccaccatctcgccgccccgcgcggccgacgcgccgccgccgagcctcgcctacccgcagcagcatctcctccacggcgcctcctcctccgcagcagcccgcgcccccgctggcgctctccagctccacctcgacgcgagcctgcacgcggcggcggcgtcgccatcgccgccgccgtcctaccacaggtacgcccactacacaccgccagcgtcgtcgctcttcccgggcggcggctacggctacgactacgactacgggcagtccaaggagctcaggcgacggcacttccacgcgctcggggccgacctgagcctcgacaagccgctgcccgagcccgacaccggctccgacgagaagcagcccctgcggcgtttcttcgacgagtggccgcgggagagcggcgacatggcggcggacgacgcgacgcagctttccatctccatccccgcggcttcgccctccgacctcgctgctacctccgcctccgccgccgccgcgcgattccacaacggggagtgatcggtccatctcctagctgcagccctgcaacagcgtggattgaccgctgcatttcctggctgcaatgcaagcctgcaacagcgagcagtaagccagtgacgtggatgcatctcgtagcggcaaaccctgcttctgcctct

SEQ ID NO: 110 - protein, 321 aa, Zea mays
MMLSGHGGGRRLFTASQWQELEHQALIFKYMASGAPVPHDLVLPLRLATGVDTAPSLAFPPQPSPSLAYWGCYGAGAPFVGRKAAEDTEPGRCRRTDGKKWRCSREAHGDSKYCEKHIHRGKSRSRKPVEVTSSPAAGAAAAYRPSAISTISPPRAADAPPPSLAYPQQHLLHGASSSAAARAPAGALQLHLDASLHAAAASPSPPPSYHRYAHYTPPASSLFPGGGYGYDYDYGQSKELRRRHFHALGADLSLDKPLPEPDTGSDEKQPLRRFFDEWPRESGDMAADDATQLSISIPAASPSDLAATSASAAAARFHNGE

SEQ ID NO: 111 - DNA, 1516 bp, Zea mays
ttcggcacgacccaacaatgcacaccaacatccactccctcgtcaggctcctctcccccaaatgagcgctgagttctgcgctgctgcgggtgtcgtggccatggagctcggggtcggagatgcgctggggctgcagcaaggcatcgcaatcaccgcgccatcgcccagggacagcgacctgggtcttctcaagcgagcaggcctcacccaggctgcggctgctgccccctacccctcccccttccttgacggggagaagatgctcaggttctccaaggcggctcacacatcgcactcaggcttggattttggaggcccaggtgagcaggctttcctgctgtccaggaccaagatgccatttactccctcgcagtggatggagctggggcaccaggctctgatatacaagtacctcaatgcaaaggcccccataccttccagcctgctcatttcaatcagcaagagcttcagatcatccaatagagtgagctggaggcctctgtatcaaggctacacaaatgcagactctgacccagaacctgggagatgccgacgaacggatggaaagaagtggcggtgctccaaggaagcaatggctgatcacaagtactgtgagcggcacatcaacagaaaccgtcaccgttcaagaaagcctgtggaaaatcaacctaagaagaccaccaaggaggtgcctgctgctgctggctcattaccatgtgctgggccacaaggtagcttgaagaaggcaaaagttaatgactccaagccaggcactgtcagctattgggcagatagtttaaacaggacaatgttgagcagagagaaagcaaacaaaccgacggaagatagctctttgctgcttacttctacgaacagccaacccacctggtccctgctctctcagctgaagcagcaaaacaaaccagataagttaggccccacactggaaaatgagtcaaacccagacacaatattgaaagcctggggtggcaaccagcctagccacaagagcatttcctctacagagcgccatgatgctgaatccctccaatcagtccttcaaaatctcagcctagcccagaatgagaagatggagtcagaaaaggacaaatattctgattccgtgctagtttcgtcgactttctattctgcaggcggtccaagagctacctgccttacacctaacatgacacaggtgaagcaggattgcatatcaagctcttgggagatgcctcaaggtggacctctaggcgaaatcttaacgaactccaagaatagcaaggacttaagcaagtgcaaaccaaggtcatatggttggttgttgaatcttgaccatgcaccatgattcctcaatccatgaagagcttgacatagatgtcccatcatgtaggcaaacaatggtcagaaaaaggttatgaccacattgcttgccccatgcatgcttgctatctacatttgtatttctgttgcgtagcatttagctagttgaattatcagttcttctggatacggctgt

SEQ ID NO: 112 - protein, 427 aa, Zea mays
MSAEFCAAAGVVAMELGVGDALGLQQGIAITAPSPRDSDLGLLKRAGLTQAAAAAPYPSPFLDGEKMLRFSKAAHTSHSGLDFGGPGEQAFLLSRTKMPFTPSQWMELGHQALIYKYLNAKAPIPSSLLISISKSFRSSNRVSWRPLYQGYTNADSDPEPGRCRRTDGKKWRCSKEAMADHKYCERHINRNRHRSRKPVENQPKKTTKEVPAAAGSLPCAGPQGSLKKAKVNDSKPGTVSYWADSLNRTMLSREKANKPTEDSSLLLTSTNSQPTWSLLSQLKQQNKPDKLGPTLENESNPDTILKAWGGNQPSHKSISSTERHDAESLQSVLQNLSLAQNEKMESEKDKYSDSVLVSSTFYSAGGPRATCLTPNMTQVKQDCISSSWEMPQGGPLGEILTNSKNSKDLSKCKPRSYGWLLNLDHAP

SEQ ID NO: 113 - DNA, 1139 bp, Zea mays
gtaggtcgttcgcaggtaggtaaccgtaacctagctagctcgtcgggatgatgatgatgagcggtcgagcggccaccgcggggcggtacccgttcacggcgtcgcagtggcaggagctggagcaccaggcgctcatctacaagtgcctggcgtccggcaagcccatcccgtcctacctcatgccaccgctccgccgcatcctcgactccgccctcgccacgtcgccgtcgctcgccgccttccagccgcaaccctcgctggggtgggggggctgcttcgggatgggcttcagcaggaagcccgccgacgaggacccggagcccgggcggtgccggcgcacggacggcaagaagtggcgctgctccaaggaggcgtacccggactccaagtactgcgagaagcacatgcaccggggcaagaaccgttcaagaaagcctgtggaaatgtccttggccacgccggcgccgccggcctcctccgctgccaccacctcgacgtccccggcgccgtcctaccaccgcccggcccccgccgcgcacgacgccgtgccgtaccacgcgccctacggcgccgcgtaccatcacacgcagacgcaggtgatgagccccttccacctccacctcgagaccacccacccgcacccgccgccgccgccgccctactactacgcggaccagagggactacgcctacggcaaggaggtcggcgagcgcgccttcttctccgacggcgcgggggagagggaccgccagcagcaggccgcggggcagtggcagttcaagcagctcgggacgatggaggcgacgaagccgtgccccacccccacgccgctgctccccgccgccgggtacggcgtcggtcaggccaaggaagacgaggaggaggaaacgcggcggcagcagcagcagcactgcttcgttcttggcgccgacctgcggctggcggagcggccgtcgggggcacatgacgacgccgcgcagaagccgctccggcatttcttcgacgagtggccgcacgagaaagggagcaaggcggggtggtggattgggggactcgacggcgagacgacgcagctctccatgtccatcccgatggcggccgctgccgacctccccgtcacctcccgctaccgtacgtga

SEQ ID NO: 114 - protein, 363 aa, Zea mays
MMMMSGRAATAGRYPFTASQWQELEHQALIYKCLASGKPIPSYLMPPLRRILDSALATSPSLAAFQPQPSLGWGGCFGMGFSRKPADEDPEPGRCRRTDGKKWRCSKEAYPDSKYCEKHMHRGKNRSRKPVEMSLATPAPPASSAATTSTSPAPSYHRPAPAAHDAVPYHAPYGAAYHHTQTQVMSPFHLHLETTHPHPPPPPPYYYADQRDYAYGKEVGERAFFSDGAGERDRQQQAAGQWQFKQLGTMEATKPCPTPTPLLPAAGYGVGQAKEDEEEETRRQQQQHCFVLGADLRLAERPSGAHDDAAQKPLRHFFDEWPHEKGSKAGWWIGGLDGETTQLSMSIPMAAAADLPVTSRYRT

SEQ ID NO: 115 - protein, 39 aa, Artificial sequence
  QLQ domain
RPPFTPTQWEELEHQALIYKYMVSGVPVPPELIFSIRRS

SEQ ID NO: 116 - protein, 44 aa, Artificial sequence
  WRC domain
DPEPGRCRRTDGKKWRCSREAYPDSKYCEKHMHRGRNRARKSLD

SEQ ID NO: 117 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 118 - DNA, 58 bp, Artificial sequence
  primer: prm10010
ggggacaagtttgtacaaaaaagcaggcttaaacaatgatgagtctaagtggaagtag

SEQ ID NO: 119 - DNA, 52 bp, Artificial sequence
  primer: prm10011
ggggaccactttgtacaagaaagctgggtagctctacttaattagctaccag

SEQ ID NO: 120 - DNA, 785 bp, Oryza sativa
tccatccacccatagctatctctagctagcttgcacattcttcattcttcttgcaatcagagctagagaaaaagagtttgagagagatctaagagatgtcaggggtttgggtgttcaagaacggggtggtgagattggtggagaagcagcaggcgacggcggggacggcggtggcgggagggaggaggaaggcgctggtgcacacgccgagcgggcaggtggtgtcgtcgtacgcggcgctggaggcgcggctgacggcgctcgggtgggagcgctactacgaggacccctccctcttccagttccacaagcgtggctccctcgacctcatctccctccccgccgacttctccgccttctcctccgtccacatgtacgacatcgtcgtcaagaaccgcgactccttccgcgtcgtcgacgcctaaattgacctatgtataggctcgcatgcatgcaaggtagacgaccatccaccttgcatgcatgcaggctatcattctctcttcgtctccgtcttcgtctttcatctttgttgtggtgtgtgtgaatttattatacttcttatgactgtgtgtgtgactgtgtgagagttcatggagagtgatgagtagtggtatacatatgtgtcgtcgctgatcgatttggtttattaccttgtgggtgggtattaattatcagcagtgtgttatatcaattgcttacttgtatgtgtatcatgtacatgagtgagtgtggctgatgcatatatatagaggtctttaataattatgtactatatatttgtg

SEQ ID NO: 121 - protein, 109 aa, Oryza sativa
MSGVWVFKNGVVRLVEKQQATAGTAVAGGRRKALVHTPSGQVVSSYAALEARLTALGWERYYEDPSLFQFHKRGSLDLISLPADFSAFSSVHMYDIVVKNRDSFRVVDA

SEQ ID NO: 122 - DNA, 53 bp, Artificial sequence
  primer: prm09129
ggggacaagtttgtacaaaaaagcaggcttaaacaatgtcaggggtttgggtg

SEQ ID NO: 123 - DNA, 50 bp, Artificial sequence
  primer: prm09988
ggggaccactttgtacaagaaagctgggttgtcgcataggtcaatttagg

SEQ ID NO: 124 - DNA, 2194 bp, Oryza sativa; identical to SEQ ID NO: 117

SEQ ID NO: 125 - DNA, 1130 bp, Oryza sativa
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcggccttctcgcaggattcagcc

SEQ ID NO: 126 - DNA, 321 bp, Oryza sativa
atggcgggaggaggggtgtgggtgttcaggaacaacggggtgatggagctggaggagcaggcgacgagcaggaaggcgctggtgcatgtggcgacgagcgaggtgatccggtcgacggaggcgctggagcggaggctgggggcgctggggtgggagcgctactacgaggaccgcgccaccctgcagctccacaggcgcgacggcagcgccgacctcatctccatcccccgcgacttctcccgcttccgctccacccacatgtacgacgtcgtcgtcaagaaccgcgaccacttcaaggttgatgtgatggaaaagaactga

SEQ ID NO: 127 - protein, 106 aa, Oryza sativa
MAGGGVWVFRNNGVMELEEQATSRKALVHVATSEVIRSTEALERRLGALGWERYYEDRATLQLHRRDGSADLISIPRDFSRFRSTHMYDVVVKNRDHFKVDVMEKN

SEQ ID NO: 128 - DNA, 318 bp, Oryza sativa
atggcgggaggaggggtgtgggtgttcaggaacaacggggtgatggagctggaggagcaggcgacgagcaggaaggcgctggtgcatgtggcgacgagcgaggtgatccggtcgacggaggcgctggagcggaggctgggggcgctggggtgggagcgctactacgaggaccgcgccaccctgcagctccacaggcgcgacggcagcgccgacctcatctccatcccccgcgacttctcccgcttccgctccacccacatgtacgacgtcgtcgtcaagaaccgcgaccacttcaaggtcgtcgacctccacacctag

SEQ ID NO: 129 - protein, 105 aa, Oryza sativa
MAGGGVWVFRNNGVMELEEQATSRKALVHVATSEVIRSTEALERRLGALGWERYYEDRATLQLHRRDGSADLISIPRDFSRFRSTHMYDVVVKNRDHFKVVDLHT

SEQ ID NO: 130 - DNA, 672 bp, Arabidopsis thaliana
aaatcattcaagaaaccaaaactaaggagaggaagaagaagatcatgtcaggcgtgtgggtcttcaagaacggagtgataagacttgtggagaaccctaaccagtcaggatccgacacacagaaccgaaggaaagtgatggtctatttaccgacaggagaagtggtctcatcttactcgacgctcgagcagatcctccagagtcttggatgggagagatactttggcggcggcgacacagatctcctccaattccacaaacgctcctccattgatctcatttccctgcctagagatttcaccaaattcaactccgtttacatgtacgatatcgtcgtcaagaaccctaattacttccatgtccgagactcccattgattcttcttttgtgtgttggtgtgtgtgttgtgttcggttgttttataatttagagtttgttgggttttgttttatagttgcatgtgcatgttttatttgttttggacgttggaagttgtgttacgtaattctggtttgatgaaagttgagattaagaagggacatgaattagggagaactcaatttcaaaattaattgttctcttccttagcatgattgttctcttcactggttgtaattgaaagatattctctttggctcagtggatccaaattgttttctatcttctatttaa

SEQ ID NO: 131 - protein, 110 aa, Arabidopsis thaliana
MSGVWVFKNGVIRLVENPNQSGSDTQNRRKVMVYLPTGEVVSSYSTLEQILQSLGWERYFGGGDTDLLQFHKRSSIDLISLPRDFTKFNSVYMYDIVVKNPNYFHVRDSH

SEQ ID NO: 132 - DNA, 442 bp, Oryza sativa
cgaagggaggatcgaggaattcagttaagcaaaaatatttatacatgtcgggcgtgtgggtgttccggaacggggtggtgaagctggtggagaacccgccggcgtcggcgaacagcggcggcggcggcggcggcggcggcggcggtggcggcggcggcatccggcgcaaggcgctgctgcacatgccgacgggtgaggtggtcacctcctacgcctccctggagcgcaagctcgccgcgctcggctgggagcgctactactccggcggcggcggcgccgccgccgccgccgccatgatgctccagttccacaagcgctcgtcggtggacctgatctcgctgcccaaggacttctcccagttcggctccgtccacatgtacgacatcgtcgtcaagaaccgcgacgccttccgagtcatcgacgtctaatcacccaagtgtct

SEQ ID NO: 133 - protein, 127 aa, Oryza sativa
MSGVWVFRNGVVKLVENPPASANSGGGGGGGGGGGGGGIRRKALLHMPTGEVVTSYASLERKLAALGWERYYSGGGGAAAAAAMMLQFHKRSSVDLISLPKDFSQFGSVHMYDIVVKNRDAFRVIDV

SEQ ID NO: 134 - DNA, 339 bp, Arabidopsis thaliana
atgtcaggagtttgggtgttcaataacggagtgatacgtctagtggagaacccgaaccagtccggtggagtttccacacagtcgcacggccggagaaatgtcttggtttacttgccgaccggtgaagccgtctcatcttactcgtcgctcgaacaaatcctaaggagcctcgggtgggaaagatacttcagtggagactccgatctcatccagtaccacaaacgctcctccatcgacctcatctccttaccaagagacttctccaagttcaactccgtttacatgtacgacatcgttgtcaagaaccctaattccttccacgtccgcgatttcaattga

SEQ ID NO: 135 - protein, 112 aa, Arabidopsis thaliana
MSGVWVFNNGVIRLVENPNQSGGVSTQSHGRRNVLVYLPTGEAVSSYSSLEQILRSLGWERYFSGDSDLIQYHKRSSIDLISLPRDFSKFNSVYMYDIVVKNPNSFHVRDFN

SEQ ID NO: 136 - DNA, 546 bp, Arabidopsis thaliana
atgataatctacttgtcagtctacacacccctttaccaacatatatatatatatatagcacacactctacacggtttccttatcctcatcaaaattaacaaactcatttttgaatacccaaaaaaaaacctagctagctcgaatttttttaaatatataataacatcaacaatgtctggtgtgtgggtattcaacaaaaacggagtcatgaggctggtggagaatccttacaaccaatccgccggagattcgtcggaatcgtcctcttccggtggtaaccagcagcagaggatgaggaggaaaattctcgtccatcttccaagcagcgaggttgtgtcttcgtacggatcacttgagaagatcttgaagaatcttgggtgggagaggtactacagtggagacaataccgatcatctgctccagttccacaagagaacttcgatcgatctcatctctctccctcgtgacttctccaagtttaactctattcacatgtatgatatcgtcgtcaagaaccctaacgtcttccatgtccgtgacatgtag

SEQ ID NO: 137 - protein, 181 aa, Arabidopsis thaliana
MIIYLSVYTPLYQHIYIYIAHTLHGFLILIKINKLIFEYPKKNLASSNFFKYIITSTMSGVWVFNKNGVMRLVENPYNQSAGDSSESSSSGGNQQQRMRRKILVHLPSSEVVSSYGSLEKILKNLGWERYYSGDNTDHLLQFHKRTSIDLISLPRDFSKFNSIHMYDIVVKNPNVFHVRDM

SEQ ID NO: 138 - DNA, 899 bp, Oryza sativa
ggcaccaccaccattgctgagctccaaagcttctagctgtgatcaagcaaagaagaattgaaaaaaaacatatatatattatatatatggcaggggtgtgggtgtttgaggatgggatggtgaggagggcagatagcgaggcgccgtcgagagggcgcggtgtcggtggtggaggtgggggagggaaggtgcttgtgcacgtgccgagcagcgaggtggtgacgagctacgaggttctggagaggcggctgcgggagctcgggtgggagaggtacctcaacgacccgtgcctcctccagttccaccagcgctccaccgtccacctcatctccgtgccccgcgacttctcccgcctcaagctcgtccacatgtacgacgtcgtcgtcaagacccgcaacgtcttcgaggtccgtgacgccgccaccactgcttccccgccatgatcgcatcgatgtctatgctttgatcatcatcgatatgaccttcctcgactccgggctcaggccagacacgccgccatggcgcctacaatcgtatgtgtgtattgtatgaatctcaattcaggtaatgaatgattgtatatcatatgatttgtaattctgtacaggtataacgtatgcgtatatacgtacgtgtgcgatcgatcgggtgtgtgtgatatatattaaaataagcgtggctggtttaattgcaagtgagtgtttagttatttaattatacgagagccatgagcacgtgtgtagctagctttggagtcttgtactttgtggtttggagccattgcttgactgattccgtggcacgaatcaatcatccatgcgttatgcagtgacaataaataattagttttgtcacaattaattaatagtatgttgtttgctgtattgattaaaaaacaa

SEQ ID NO: 139 - protein, 108 aa, Oryza sativa
MAGVWVFEDGMVRRADSEAPSRGRGVGGGGGGGKVLVHVPSSEVVTSYEVLERRLRELGWERYLNDPCLLQFHQRSTVHLISVPRDFSRLKLVHMYDVVVKTRNVFEV

SEQ ID NO: 140 - DNA, 330 bp, Oryza sativa
atgtcaggggtttggctgttcaagaacggggtggtgagattggtggagaagcagcaggcgacggcggggacgtcggtggcgggagggaggaggaaggcgctggtgcacacgccgagcgggcaggtggtgtcgtcgtacgcggcgctggaggcgcggctgacggcgctcgggtgggagcgctactacgaggacccctccctcttccagttccacaagcgtggctccctcgacctcatctccctccccgccgacttctccgccttctcctccgtccacatgtacgacatcgtcgtcaagaaccgcgactccttccgcgtcgtcgacgcctaa

SEQ ID NO: 141 - protein, 109 aa, Oryza sativa
MSGVWLFKNGVVRLVEKQQATAGTSVAGGRRKALVHTPSGQVVSSYAALEARLTALGWERYYEDPSLFQFHKRGSLDLISLPADFSAFSSVHMYDIVVKNRDSFRVVDA

SEQ ID NO: 142 - DNA, 333 bp, Sinapis alba
atgtcaggcgtgtgggtgttcaagaacggagtgataaggcttgtggagaaccctaaccagtcaggaggcgacacaaatagccgaaggaaagtgatggtctatttaccgacaggagaagtgatctcatcttactccacgctcgagcagatcctccggagtcttggatgggagaggtacttcggtggcggcgacacagatcttctccaattccacaaacgctcatccattgatctcatctctctccctaaagatttcaccaaattcagctctgtttacatgtacgatattgtcgtcaagaaccctaattacttccacgtccgagactccaattaa

SEQ ID NO: 143 - protein, 110 aa, Sinapis alba
MSGVWVFKNGVIRLVENPNQSGGDTNSRRKVMVYLPTGEVISSYSTLEQILRSLGWERYFGGGDTDLLQFHKRSSIDLISLPKDFTKFSSVYMYDIVVKNPNYFHVRDSN

SEQ ID NO: 144 - DNA, 369 bp, Oryza sativa
atggcgggcgtgtgggtgttcaaggacggcatcgtgcggcgcgtggagaaccccggcagcgaggaatcgtcgtcggcggggaacggcggcggaggcgggcggcggaaggtgctggtgcacgtgccgagcggggaggtggtggcgtcatacgaggtgctggagcggcggctgcgggagctcgggtgggagaggtacctcaccgacccgtgcctcctgcagttccaccagcgctccaccgtgcacctcatctctgtcccccgcgacttctccaagttcaagctcgtccacatgtacgacatcgtcgtcaagacccgcaacgtcttcgaggtccgcgacgccgccgcccccgccgtctcaccggcgacctag

SEQ ID NO: 145 - protein, 122 aa, Oryza sativa
MAGVWVFKDGIVRRVENPGSEESSSAGNGGGGGRRKVLVHVPSGEVVASYEVLERRLRELGWERYLTDPCLLQFHQRSTVHLISVPRDFSKFKLVHMYDIVVKTRNVFEVRDAAAPAVSPAT

SEQ ID NO: 146 - DNA, 1098 bp, Oryza sativa
agcggctgtatagctgctgccactcaactgtgcaggactcctagctccctgctacatataccggccggtcggaccccctcatcttgccggcctcatcatcgtcaccgatcgatcccggccattccacggtcgatcgatcgtctccggccggccggtcgccggtgggaattgaagcagctagctgacatacatacatggcgggcgtgtgggtgttcaaggacggcatcgtgcggcgcgtggagaaccccggcagcgaggaatcgtcgtcggcgggggacggcggcggaggcgggcggcggaaggtgctggtgcacgtgccgagcggggaggtggtggcgtcatacgaggtgctggagcggcggctgcgggagctcgggtgggagaggtacctcaccgacccgtgcctcctgcagttccaccagcgctccaccgtgcacctcatctctgtcccccgcgacttctccaagttcaagctcgtccacatgtacgacatcgtcgtcaagacccgcaacgtcttcgaggtccgcgacgccgctgcccccgccgtctcaccggcgacctagctgctgatccgagatccatccatccatcgatcagacgacagcttatagctacagcagtccacatgagcttgcctgcctgctattataagagtgtaagtatgtatatatatactggtatgcgtgtgatcgatcaaggatcgatgtacacacaaatgatcagcatgcacagatcactagatcgagatctatagctcgatcgatttggggtttctcctgccggcgttgcagcttttggattagatgttgcgccggtgaggacattgctataggttaattggcttttgggtatatttctgcataaataatgcatcaatagagagcacaacatgtgtatgcatacttatatttatatgtacacatgcatacatatataagtacatacataggggccgggggcaacatgcaggttgcagagattctgccagagatcaagcagaaaggggatcgccgatgccctactctcaaccgtacctttttactgtttaatttggaataatttggattgtctcaatacaaattatgtaccagttttttc

SEQ ID NO: 147 - protein, 122 aa, Oryza sativa
MAGVWVFKDGIVRRVENPGSEESSSAGDGGGGGRRKVLVHVPSGEVVASYEVLERRLRELGWERYLTDPCLLQFHQRSTVHLISVPRDFSKFKLVHMYDIVVKTRNVFEVRDAAAPAVSPAT

SEQ ID NO: 148 - DNA, 934 bp, Oryza sativa
cgaaaattctggaattctgcatttaatatatatatatatatcatataatataatgataatctacttgtcagtctacacacccctttaccaacatatatatatatatatagcacacactctacacggtttccttatcctcatcaaaattaacaaactcatttttgaatacccaaaaaaaaacctagctagctcgaatttttttaaatatataataacatcaacaatgtctggtgtgtgggtattcaacaaaaacggagtcatgaggctggtggagaatccttacaaccaatccgccggagattcgtcggaatcgtcctcttccggtggtaaccagcagcagaggatgaggaggaaaattctcgtccatcttccaagcagcgaggttgtgtcttcgtacggatcacttgagaagatcttgaagaatcttgggtgggagaggtactacagtggagacaataccgatcatctgctccagttccacaagagaacttcgatcgatctcatctctctccctcgtgacttctccaagtttaactctattcacatgtatgatatcgtcgtcaagaaccctaacgtcttccatgtccgtgacatgtagtagtcaatcatccaaaacaatggttcaatatcattctccgatcatcgccgctggtgatatatctatcatgtatatatatatgcaggtttttattttgtcgttgggtgtttttgtttttggtttattttgtttttaatgcatttaatgtacgtgttttccgttcgacgtcgatcgattggggtgggttcaagctagagccattctaataacttttatcattttgtgattttaatgaaattgtatcatgttgtcaagttctcttattatggagtggatcaaaaaatatatacagtacatcaaatttcgaatgttatatgatgaaatatcataatttgg

SEQ ID NO: 149 - protein, 124 aa, Oryza sativa
MSGVWVFNKNGVMRLVENPYNQSAGDSSESSSSGGNQQQRMRRKILVHLPSSEVVSSYGSLEKILKNLGWERYYSGDNTDHLLQFHKRTSIDLISLPRDFSKFNSIHMYDIVVKNPNVFHVRDM

SEQ ID NO: 150 - DNA, 357 bp, Oryza sativa
atggcaggggtgtgggtgtttgaggatgggatggtgaggagggcagatagcgaggcgccgtcgagagggcgcggtgtcggtggtggaggtgggggagggaaggtgcttgtgcacgtgccgagcagcgaggtggtgacgagctacgaggttctggagaggcggctgcgggagctcgggtgggagaggtacctcaacgacccgtgcctcctccagttccaccagcgctccaccgtccacctcatctccgtgccccgcgacttctcccgcctcaagctcgtccacatgtacgacgtcgtcgtcaagacccgcaacgtcttcgaggtccgcgacgccgccaccactgctgccccgccatga

SEQ ID NO: 151 - protein, 118 aa, Oryza sativa
MAGVWVFEDGMVRRADSEAPSRGRGVGGGGGGGKVLVHVPSSEVVTSYEVLERRLRELGWERYLNDPCLLQFHQRSTVHLISVPRDFSRLKLVHMYDVVVKTRNVFEVRDAATTAAPP

SEQ ID NO: 152 - DNA, 309 bp, Nicotiana tabacum
atgtctggagtttgggtattcaagaatggagttgtccgacttgaagattgtcaaggctcaagtggtcgtcgaaaagtgttagttcatgttccaagtaatgaagtcatcacatcctatgcagtacttgaaaggaaacttcattctcttggttgggaaaggtattatgatgatcttgaccttcttcagtaccataaaagatcaactgttcatctcatttctctcccaaaagatttcaacaagttgaagcccatgcacatgtacgatattgtcgtcaagaatcgcaatgagtttgaagttagagacatatga

SEQ ID NO: 153 - protein, 102 aa, Nicotiana tabacum
MSGVWVFKNGVVRLEDCQGSSGRRKVLVHVPSNEVITSYAVLERKLHSLGWERYYDDLDLLQYHKRSTVHLISLPKDFNKLKPMHMYDIVVKNRNEFEVRDI

SEQ ID NO: 154 - DNA, 2415 bp, Arabidopsis thaliana
atgtcaggagtttgggtgttcaataacggagtgatacgtctagtggagaacccgaaccagtccggtggagtttccacacagtcgcacggccggagaaatgtcttggtttacttgccgaccggtgaagccgtctcatcttactcgtcgctcgaacaaatcctaaggagcctcgggtgggaaagatacttcagtggagactccgatctcatccagtaccacaaacgctcctccatcgacctcatctccttaccaagagacttctccaagttcaactccgtttacatgtacgacatcgttgtcaagaaccctaattccttccacaaacaaacgatgcctcgtaaaggattatccaatttcgatgattatgatgatggttttgatgatgatgacgatgcttttgattatgactatgatgttgatatagatgaacatgaagaagaagctgctgctgaaccaaaggaagaaattgctaaaacgcaagggctttggcgatgtgctatctgtacatatgacaatgttgagactatgtttgtgtgtgatatctgcggtgttcttcgtcatcctgtcgccggaaatcaaagtatcaataagaatacagctgttcgtgttgtgagtctctttgcaattgtggtgttgcaaaggcgttattctgacagttccttttcaacttatgtagcacctttcaagtttgatgctccatcgccagatgatttagtctccaatggactaacatcctcaaaaactggtccaaaaggctcaggtgatgctagcatgagacagaaggagaagcaagatagcgtagaacagaaacctttaaagaaaggaggagatagttcagaaacaagctcccgaggtagacatgataaacttgatgataagggcggtgctggcggcataaaatcaggcaaaagtttgccaaaagcaaaagcagatatgtctaatgagacaagttcgtcctctaaatatatggagacgtcggagagtcttactggtactatgaacaagatgtctttgattggggaaacagaaaactctagcgatattaaaattagaggaccaaaatcacaatctaagcataagccagaggagtggatgcttcttgataaagaatcagatgcactaagccagcttaatcttgccatcgtggggcatgttgattccggtaagtctacactttcgggtagattattgcatcttttgggaagaatatcgcagaagcaaatgcacaagtatgagaaagaagcaaagttgcagggcaaagggtcctttgcatatgcctgggcattggatgagagtgctgaagagagggaacgaggaataacaatgactgtggctgttgcttatttcaattccaaaagacatcatgttgttttgctcgactctcctggacacaaagattttgttccaaacatgatagcaggagcaacacaagcagatgctgcgattcttgtcatagatgcatctgttggtgcttttgaagctggttttgataatttgaaagggcagacaagggagcatgcacgggttctgagaggttttggcgtggagcaagtcatagttgcaatcaacaaaatggatattgttggctactcaaaggaaagatttgatttgattaagcagcacgttggatcttttttgcaatcctgtcgttttaaggattcttctctgacatggattccattaagtgccatggaaaaccaaaacttggtggcagctccctctgataaccgcctatcctcatggtatcaaggtccatgtttattggatgccgtcgactctgtcaagtctcctgatagagacgtctcaaagcctctactcatgcctatatgtgacgctgtaagatcaacttcgcaagggcaggtatctgcatgtggcaaacttgaagctggagctgtccggccaggatctaaggtaatggttatgccatcaggagatcaaggaaccatacgatcactagagcgtgactctcaggcttgcaccattgcaagagctggagataacgtagcgttagcgttgcaagggatcgatgcaaatcaagtaatggcaggagatgtattgtgccatcctgatttccctgtatcagtagcaactcatttggaattgatggtgctcgtcttggaaggcgcaacaccgatcttgctcggttctcagttggagtttcatgtgcatcatgcaaaggaagcagcaacagttgtgaaacttgtggcaatgcttgatcccaaaacagggcagccaacaaagaagtctcctcgttgtctaactgctaaacagagcgcaatgcttgaggttagtctccaaaatccagtatgtgtggagacattttctgagagtagagctcttggaagagtgttccttagatcatcgggaagaactgttgctatgggcaaagttactcggattatccaagactcataa

SEQ ID NO: 155 - protein, 804 aa, Arabidopsis thaliana
MSGVWVFNNGVIRLVENPNQSGGVSTQSHGRRNVLVYLPTGEAVSSYSSLEQILRSLGWERYFSGDSDLIQYHKRSSIDLISLPRDFSKFNSVYMYDIVVKNPNSFHKQTMPRKGLSNFDDYDDGFDDDDDAFDYDYDVDIDEHEEEAAAEPKEEIAKTQGLWRCAICTYDNVETMFVCDICGVLRHPVAGNQSINKNTAVRVVSLFAIVVLQRRYSDSSFSTYVAPFKFDAPSPDDLVSNGLTSSKTGPKGSGDASMRQKEKQDSVEQKPLKKGGDSSETSSRGRHDKLDDKGGAGGIKSGKSLPKAKADMSNETSSSSKYMETSESLTGTMNKMSLIGETENSSDIKIRGPKSQSKHKPEEWMLLDKESDALSQLNLAIVGHVDSGKSTLSGRLLHLLGRISQKQMHKYEKEAKLQGKGSFAYAWALDESAEERERGITMTVAVAYFNSKRHHVVLLDSPGHKDFVPNMIAGATQADAAILVIDASVGAFEAGFDNLKGQTREHARVLRGFGVEQVIVAINKMDIVGYSKERFDLIKQHVGSFLQSCRFKDSSLTWIPLSAMENQNLVAAPSDNRLSSWYQGPCLLDAVDSVKSPDRDVSKPLLMPICDAVRSTSQGQVSACGKLEAGAVRPGSKVMVMPSGDQGTIRSLERDSQACTIARAGDNVALALQGIDANQVMAGDVLCHPDFPVSVATHLELMVLVLEGATPILLGSQLEFHVHHAKEAATVVKLVAMLDPKTGQPTKKSPRCLTAKQSAMLEVSLQNPVCVETFSESRALGRVFLRSSGRTVAMGKVTRIIQDS

SEQ ID NO: 156 - DNA, 852 bp, Oryza sativa
gcaccaccaccattgctgagctccaaagcttctagctgtgatcaagcaaagaagaattgaaaaaaaacatatatatattatatatatggcaggggtgtgggtgtttgaggatgggatggtgaggagggcagatagcgaggcgccgtcgagagggcgcggtgtcggtggtggaggtgggggagggaaggtgcttgtgcacgtgccgagcagcgaggtggtgacgagctacgaggttctggagaggcggctgcgggagctcgggtgggagaggtacctcaacgacccgtgcctcctccagttccaccagcgctccaccgtccacctcatctccgtgccccgcgacttctcccgcctcaagctcgtccacatgtacgacgtcgtcgtcaagacccgcaacgtcttcgaggtccgtgacgccgccaccactgcttccccgccatgatcgcatcgatgtctatgctttgatcatcatcgatatgaccttcctcgactccgggctcaggccagacacgccgccatggcgcctacaatcgtatgtgtgtattgtatgaatctcaattcaggtaatgaatgattgtatatcatatgatttgtaattctgtacaggtataacgtatgcgtatatacgtacgtgtgcgatcgatcgggtgtgtgtgatatatattaaaataagcgtggctggtttaattgcaagtgagtgtttagttatttaattatacgagagccatgagcacgtgtgtagctagctttggagtcttgtactttgtggtttggagccattgcttgactgattccgtggcacgaatcaatcatccatgcgttatgcagtgacaataaataattagttttgtc

SEQ ID NO: 157 - protein, 118 aa, Oryza sativa
MAGVWVFEDGMVRRADSEAPSRGRGVGGGGGGGKVLVHVPSSEVVTSYEVLERRLRELGWERYLNDPCLLQFHQRSTVHLISVPRDFSRLKLVHMYDVVVKTRNVFEVRDAATTASPP

SEQ ID NO: 158 - DNA, 306 bp, Oryza sativa
atggggtcgctgcaggcgctggagcggaggctggcggggctcgggtgggagcgctactacgaggaccgcgccgtggtgcagctccaccgccgcgacggcggcgccgacctcatctccctcccccgcgacttcgcccgcttccgctccacccacatgtacgacgtcgtcctcaagaaccgcgaccacttcaagggaggaagcgcagaggagagggcgtggctccgtcggctgtcggcgacctcgacggcggcgggaggtggccccggctgcggtggcgctaaggatcggagtggcagccggtggtag

SEQ ID NO: 159 - protein, 101 aa, Oryza sativa
MGSLQALERRLAGLGWERYYEDRAVVQLHRRDGGADLISLPRDFARFRSTHMYDVVLKNRDHFKGGSAEERAWLRRLSATSTAAGGGPGCGGAKDRSGSRW

SEQ ID NO: 160 - DNA, 371 bp, Vitis vinifera
atgtctggtgtttgggtattcgacaagaatggcgtggcccggctcgtacgaacccgacccgggagtcgttcgaacaaaaggagccgccatttccgggcacagccaccgccccaggtgcacgtccacggcttctggtgtacctcccagagaatcaggtgattcgaagctacacggaactggagcagcgactgaaccaactggggtggagtcggtaccacaactaccagcatcccagcctggtccagttccacaagtccgacaactcttctcacctcctgtccctccccaaaagctttgccaacttcaagtcttttcacttttacgatatcgtcgtcaagaatcgatctttctttgaagtccgcgaggcctga

SEQ ID NO: 161 - protein, 123 aa, Vitis vinifera
MSGVWVFDKNGVARLVTNPTRESFEQKEPPFPGTATAPGARPRLLVYLPENQVIRSYTELEQRLNQLGWSRYHNYQHPSLVQFHKSDNSSHLLSLPKSFANFKSFHFYDIVVKNRSFFEVREA

SEQ ID NO: 162 - protein, 5 aa, Artificial sequence
  RAA1-like polypeptide motif 1
  VARIANT (4)..(4): Xaa is Leu or Val
GVWXF

SEQ ID NO: 163 - protein, 7 aa, Artificial sequence
  RAA1-like polypeptide motif 2
  VARIANT (4)..(4): Xaa is Ser or Glu
  VARIANT (7)..(7): Xaa is Phe or Tyr
LGWXRYX

SEQ ID NO: 164 - protein, 9 aa, Artificial sequence
  RAA1-like polypeptide motif 3
  VARIANT (1)..(1): Xaa is His or Asp
  VARIANT (3)..(3): Xaa is Ile or Leu
  VARIANT (5)..(5): Xaa is Val, Leu or Ile
  VARIANT (7)..(7): Xaa is Lys, Ala or Arg
  VARIANT (8)..(8): Xaa is Asp or Phe
XLXSXPXXF

SEQ ID NO: 165 - protein, 10 aa, Artificial sequence
  RAA1-like polypeptide motif 4
  VARIANT (1)..(1): Xaa is Tyr or His
  VARIANT (2)..(2): Xaa is Met or Phe
  VARIANT (5)..(5): Xaa is Ile or Val
  VARIANT (9)..(9): Xaa is Thr or Asn
  VARIANT (10)..(10): Xaa is Pro or Arg
XXYDXVVKXX

SEQ ID NO: 166 - DNA, 2578 bp, Artificial sequence
  GOS2-RAA1-like expression cassette
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttcatttaaatcaactagggatatcacaagtttgtacaaaaaagcaggcttaaacaatgtcaggggtttgggtgttcaagaacggggtggtgagattggtggagaagcagcaggcgacggcggggacggcggtggcgggagggaggaggaaggcgctggtgcacacgccgagcgggcaggtggtgtcgtcgtacgcggcgctggaggcgcggctgacggcgctcgggtgggagcgctactacgaggacccctccctcttccagttccacaagcgtggctccctcgacctcatctccctccccgccgacttctccgccttctcctccgtccacatgtacgacatcgtcgtcaagaaccgcgactccttccgcgtcgtcgacgcctaaat

SEQ ID NO: 167 - DNA, 1515 bp, Artificial sequence
  HMGP-RAA1-like combination
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcgcccttctcgcaggattcagccatttaaatcaactagggatatcacaagtttgtacaaaaaagcaggcttaaacaatgtcaggggtttgggtgttcaagaacggggtggtgagattggtggagaagcagcaggcgacggcggggacggcggtggcgggagggaggaggaaggcgctggtgcacacgccgagcgggcaggtggtgtcgtcgtacgcggcgctggaggcgcggctgacggcgctcgggtgggagcgctactacgaggacccctccctcttccagttccacaagcgtggctccctcgacctcatctccctccccgccgacttctccgccttctcctccgtccacatgtacgacatcgtcgtcaagaaccgcgactccttccgcgtcgtcgacgcctaaat

SEQ ID NO: 168 - DNA, 353 bp, Oryza sativa
atggaaggtgtaggtgctaggcagaggaggaaccctctgatacccagaccaaacggttcaaagaggcatctgcagcatcagcatcagccaaatgctgccgagaagaagaccgccgcgacatcgaattacttcagtatcgaggcgttcctcgtgctcgtcttcctcaccatgtcattgctcatacttccattggtgcttcccccattgcctccgccgccatcgctgctgctgctgctgccagtctgcctgctcatcctgctggttgtgctggccttcatgccaacggatgtgcggagcatggcttcctcttacttgtaaatacatctcctaggggaatttatttttgtttttga

SEQ ID NO: 169 - protein, 105 aa, Oryza sativa
MEGVGARQRRNPLIPRPNGSKRHLQHQHQPNAAEKKTAATSNYFSIEAFLVLVFLTMSLLILPLVLPPLPPPPSLLLLLPVCLLILLVVLAFMPTDVRSMASSYL

SEQ ID NO: 170 - DNA, 56 bp, Artificial sequence
  primer: prm08170
ggggacaagtttgtacaaaaaagcaggcttaaacaatggaaggtgtaggtgctagg

SEQ ID NO: 171 - DNA, 51 bp, Artificial sequence
  primer: prm08171
ggggaccactttgtacaagaaagctgggtcaaaaacaaaaataaattcccc

SEQ ID NO: 172 - DNA, 2193 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 173 - protein, 3 aa, Artificial sequence
  SYR protein conserved motif 5a
YFS

SEQ ID NO: 174 - protein, 3 aa, Artificial sequence
  SYR protein conserved motif 5b
YFT

SEQ ID NO: 175 - protein, 3 aa, Artificial sequence
  SYR protein conserved motif 5c
YFG

SEQ ID NO: 176 - protein, 3 aa, Artificial sequence
  SYR protein conserved motif 5d
YLG

SEQ ID NO: 177 - protein, 7 aa, Artificial sequence
  SYR protein conserved motif 6
  VARIANT (1)..(1): Xaa is Ala, Ile or Val
  VARIANT (7)..(7): Xaa is Ser or Thr
XLAFMPX

SEQ ID NO: 178 - protein, 3 aa, Artificial sequence
  SYR protein conserved motif 7
  conserved motif 1a
  VARIANT (1)..(1): Xaa is Pro or Ser
XYL

SEQ ID NO: 179 - protein, 178 aa, Oryza sativa
MYLLSPRNGDEEDEQEEIQELISDDEPPNLKLASCATAASSSSSSGSDMEKGRGKACGGGSTAPPPPPPSSSGKSGGGGGSNIREAAASGGGGGVWGKYFSVESLLLLVCVTASLVILPLVLPPLPPPPSMLMLVPVAMLVLLLALAFMPTTTSSSSSAGGGGGGGRNGATTGHAPYL

SEQ ID NO: 180 - protein, 126 aa, Oryza sativa
MLLEHLMITMEEQMFREQQMQRGGRHHQHHTTREQEQQQKQQQRRRLMNNATNGGGGDGGSRCYFSTEAILVLACVTVSLLVLPLILPPLPPPPTLLLLLPVCLLALLVVLAFMPTDMRTMASSYL

SEQ ID NO: 181 - protein, 105 aa, Zea mays
  UNSURE (65)..(75): Xaa can be any naturally occuring amino acid
MASRSSAMEGGAAIQRRNAVKRHLQQRQQEADFLDKKVIASTYFSIGAFLVLACLTVSLLILPLXXXXXXXXXXXLLWLPVCLLVLLVVLAFMPTDVRSMASSYL

SEQ ID NO: 182 - protein, 110 aa, Triticum aestivum
MDSQFGALERGGSRQRRSPVLARPNTTKRHIQQQRANAADKKVVMPNYFSIEAFFVLACLTVSLLILPLVLPPLPPPPSLLLFVPVCLLILLMVLAFMPTDMRSMATSYL

SEQ ID NO: 183 - protein, 110 aa, Hordeum vulgare
MDSQFGAMDRGGSRQRSSPVLARPNTAKRQMQQQRANAADKKVVIPNYFGVEAFFVLACLTVSLLILPLVLPPLPPPPSLLLLLPVCLLILLMVLAFMPTDVRSMATSYL

SEQ ID NO: 184 - protein, 99 aa, Saccharum officinarum
  UNSURE (62)..(62): Xaa can be any naturally occuring amino acid
MEGGGQIQRRNNAVKRHLQQRQQEADFLDKKVIASTYFSIEAFLVLACLTVSLLILPLVLPXLPAPASLLLWLPVWLLELLIVLAFMPTDVRSMASSYL

SEQ ID NO: 185 - protein, 99 aa, Saccharum officinarum
MEGGGQIQRRNNAVKRHLQQRQQEADFLDKKVIASTYFSIEAFLVLACLTVSLLILPLVLPPLPPPPSLLLWLPVCLLILLIVLAFMPTDVRSMASSYL

SEQ ID NO: 186 - protein, 107 aa, Sorghum bicolor
MASRSSALEGGGAAIQRRNNAVKRHLQQRQQEADFHDKKVIASTYFSIGAFLVLACLTFSLLILPLVLPPLPPPPSLLLWLPVCLLVLLVVLAFMPTDVRSVAASYL

SEQ ID NO: 187 - protein, 130 aa, Arabidopsis thaliana
MIREISNLQKDIINIQDSYSNNRVMDVGRNNRKNMSFRSSPEKSKQELRRSFSAQKRMMIPANYFSLESLFLLVGLTASLLILPLVLPPLPPPPFMLLLVPIGIMVLLVVLAFMPSSHSNANTDVTCNFM

SEQ ID NO: 188 - protein, 135 aa, Arabidopsis thaliana
MIREFSSLQNDIINIQEHYSLNNNMDVRGDHNRKNTSFRGSAPAPIMGKQELFRTLSSQNSPRRLISASYFSLESMVVLVGLTASLLILPLILPPLPPPPFMLLLIPIGIMVLLMVLAFMPSSNSKHVSSSSTFM

SEQ ID NO: 189 - protein, 139 aa, Vitis vinifera
MSIEQPEADSRLSEGPLINLQDRYLSGIMEARGRRNSAPLQVERKNPTPPMAEGKKMEYNRTPLSRENSRRLIPASYFSLESLLLLICLTASLLILPLILPPLPPPPFMLLLLPIGILAVLMILAFMPSNVRDLTYTYV

SEQ ID NO: 190 - protein, 126 aa, Citrus reticulata
  UNSURE (103)..(103): Xaa can be any naturally occuring amino acid
MNSDNSESRQRLSKGIINLQDRYPTSIMDRGVRKIATPPVEKRKVEYHRSYSQGASRKLFSASYFTLESLLLLVCLTASLLILPLVLPPLPPPPFLLLLVPIXILAVLLVLAFMPSNVRDITSTYV

SEQ ID NO: 191 - protein, 118 aa, Lycopersicon esculentum
MNMDMESSEAKLRSSKGFINLEEHQQYFNNIMEGNKMEHKRSFTQGHGKKMLSMNYFSLESIILLLGLTASLLLLPLMLPPLPPPPFMLLLVPIFILVVLMILAFMPSNVRNVTCSYL

SEQ ID NO: 192 - protein, 87 aa, Lycopersicon esculentum
MEGNKMEHKRSFTQGHGKKMLSMNYFSLESIILLLGLTASLLLLPLMLPPLPPPPFMLLLVPIFILVVLMILAFMPSNVRNVTCSYL

SEQ ID NO: 193 - protein, 106 aa, Arabidopsis thaliana
MDVGRNNRKNMSFRSSPEKSKQELRRSFSAQKRMMIPANYFSLESLFLLVGLTASLLILPLVLPPLPPPPFMLLLVPIGIMVLLVVLAFMPSSHSNANTDVTCNFM

SEQ ID NO: 194 - protein, 537 aa, Oryza sativa
ATGTACTTGTTGAGCCCAAGAAATGGCGACGAGGAGGACGAACAGGAGGAAATCCAGGAGCTGATCAGCGACGACGAGCCGCCCAATCTCAAGTTGGCATCCTGCGCCACTGCAGCCAGCAGCAGCAGCAGCAGCGGCAGCGACATGGAGAAGGGAAGAGGTAAAGCCTGCGGCGGCGGGAGTACGGCGCCGCCGCCGCCGCCGCCGTCGTCGTCAGGTAAATCCGGCGGCGGCGGCGGCAGCAATATCAGGGAGGCGGCGGCTAGCGGCGGCGGCGGCGGCGTGTGGGGCAAGTACTTCTCGGTGGAGTCGCTGCTCCTGCTGGTGTGCGTGACGGCGTCGCTGGTGATCCTCCCGCTCGTGCTGCCGCCGCTGCCCCCGCCGCCGTCGATGCTGATGCTGGTGCCGGTGGCGATGCTGGTGCTGCTGCTGGCGCTGGCGTTCATGCCGACGACGACGTCGTCGTCGTCGTCCGCCGGCGGCGGCGGCGGCGGCGGCCGCAATGGGGCGACGACGGGACATGCTCCCTACTTGTAG

SEQ ID NO: 195 - DNA, 538 bp, Zea mays
  misc_feature (177)..(208): n is a, c, g, or t
  misc_feature (493)..(493): n is a, c, g, or t
ttcacattacactcatgactcgtcttaggacgaatcctgcagctgcaaaacacagaaaatctggccaagacctatttatctatttacaggtaagaggaggccatgctgcgcacatctgtcggcatgaaggccagtacaaccagcaagacgagcaggcagaccggcagccacagcagnnnnnnnnnnnnnnnnnnnnnnnnnnnnnnnnccagcggcagtatcagcagcgagacggtgaggcaggcgagcacgaggaatgccccgatgctgaagtaggtggacgcgatgaccttcttgtcgaggaaatccgcctcctgctgacgctgctgcagatgccgcttcacggcattcctcctttgtattgccgcccctccttccatcgcgctagatcggcttgccatgtgttctttggtgtaggcggaggtggagaccagtcgcagtgagtggttgccaaagtaagcaagaagtgaaaggcggtgtagaaccgccttgngttttctgaacgttttgtaatcagatctgagctcgggtggtcgaa

SEQ ID NO: 196 - DNA, 578 bp, Vitis vinifera
tactttgaaccggttggaacttggtgaccggtaaaggagaaatttaaatgagtattgagcagcctgaagcagattcaagactgtctgaaggacctttgatcaatctgcaagatcgatatttgagtggcatcatggaagcgagaggaaggaggaactctgctcctctgcaagttgagaggaaaaaccctactcctcctatggccgaaggaaagaagatggaatataatagaactcccctctcacgagagaacagcaggagactgatcccagcaagctatttcagcttggagtcattgcttttgctcatctgtctcacggcttcattgctgatccttcccctgatactaccaccattgccaccccctcctttcatgctgcttctgctccccattggcattctagcagtgcttatgatcttggctttcatgccttctaatgtcagagatttgacttatacatatgtgtaaatggtggtgttcaaaagtgcacctcttctcatcatacaatttttgttatttgtcttgatattcagatgaaaatcagttattttatttcttgattaaaaaaaaaaaaaaaaa

SEQ ID NO: 197 - DNA, 704 bp, Citrus reticulata
  misc_feature (619)..(619): n is a, c, g, or t
agggtttcttcaaagataggtagccatttgcacatttgaatctgcttgttggatattgtcaaggaggctgttggaattaggccacatttcagaatctggtttcatcctggatcgctgggcatttgaaggcattttgtgatcatcgctgtttaaaatttggccgcatattagaatctgggttctcatcggttttccgtacatttaccttgaccacattttgatatctgggttgagctgcattttagccttcgtatttaaaaggacttgatctaatctggggtcttggtgagccggggcaactgatcatagtaaatgaattctgataattctgagtcgagacagagactatcaaagggcattataaacttgcaagatcgatatccgaccagcattatggatcgtggtgtaagaaaaattgcaactcctccggtcgagaagaggaaagttgagtatcaccgaagttactcgcaaggggcatccagaaaactgttttcggcaagctatttcaccctggaatcattgcttttgctcgtatgtctgacggcctcattgctgatcctgccattggtgcttccgcccttgccgcccccgccattcctgctgcttctggttcctatangtattctagccgtgcttttggtcttggcattcatgccttctaatgtaagagatataacttccacgtacgtgtaaatggtgttgct

SEQ ID NO: 198 - DNA, 382 bp, Lycopersicon esculentum
gaaaaaaatgtatttaatcattatgtaaaaaacaagtgaatctactttgatattttcttctaaattaaaccacacaattaaagatatgagcaagtcacattcctaacattagaaggcataaaagctaagatcataagaacaacaagaatgaaaattgggactaacaacaacataaaaggtggtggtggcaatggtggaagcatcaatggcaaaagtaacaaagatgctgtaagaccaagtaacaaaataattgactctaagctaaaataattcattgacaacattttcttgccatgtccttgtgtaaatgatctcttatgctccatcttattgccttccataatgttgttgaaatattgttgatgttcctccaaattaataa

SEQ ID NO: 199 - DNA, 624 bp, Lycopersicon esculentum
tttgttaaagattggcacattttcaagttcagtattcattcgatttttgatatctacataaaaaaaaagtgtcctggtactactcaatattcctcagaacgacttcatattcaggtctcgaattcaaaacctcacatcaagattcttaggaaatttcaagattggttgaaaaactcatatccttctctaagtttcaagattggttccaaattaaaactcgagacttctgagtaagagcgtacgactagtaatgaacatggacatggaatcatcagaggcaaaattgagatcatcaaaagggtttattaatttggaggaacatcaacaatatttcaacaacattatggaaggcaataagatggagcataagagatcatttacacaaggacatggcaagaaaatgttgtcaatgaattattttagcttagagtcaattattttgttacttggtcttacagcatctttgttacttttgccattgatgcttccaccattgccaccaccaccttttatgttgttgttagtcccaattttcattcttgttgttcttatgatcttagcttttatgccttctaatgttaggaatgtgacttgctcatatctttaattgtgtggtttaattta

SEQ ID NO: 200 - DNA, 1130 bp, Oryza sativa
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcgcccttctcgcaggattcagcc

SEQ ID NO: 201 - protein, 77 aa, Medicago sativa
MVRCFSLGSVLILIALAASMVVLPLMLPPLPPPPLALLFFPVGIMAALVVLAFSPSENVKNVVVYSSSSSGIANSKR

SEQ ID NO: 202 - protein, 78 aa, Medicago sativa
MIMVASKEKTNSGGCMFRYSVLILSLLALSILVLPLVMPPLPPPPLLLLLVPVFIMLLLFFIAFSPSKKVPNKASFVS

SEQ ID NO: 203 - DNA, 613 bp, Hordeum vulgare
cttccgagaaagatgcttcatattgcactcatcttatgccaacacacaatcagaaacaaaaaccacgcagcaagcctatttacaagtaagaggtggccatgctccgcacatcagtcggcatgaaggccagcaccatcaacaggatgagcaagcagaccggcaagagcagcagtagcgatggcggtgggggcaacggaggcagcaccaatggcagtatgagcaatgaaacggtgaggcaggcgagcacgaagaacgcttcgacgccgaagtagttcggtatgacaaccttcttgtcagcagcatttgccctctgctgctgcatttgcctctttgcagtatttggtctggctaacacagggctgctcctctgcctactaccgcctctgtccattgcaccgaactggctatccatctattctttggtgagtgcagatcagcggctatccaggaactgagatgaataagaacttgtggaatctgaaggtttttaacagatctgaagtctttgtgagtccgtgactgaactgcagatcatctgctgtggaagaactgcaccgcaagtggcaataccttcgatcctgaaacttgcattttggtgatgcccgtaccacgc

SEQ ID NO: 204 - DNA, 617 bp, Saccharum officinarum
  misc_feature (451)..(451): n is a, c, g, or t
ggagaacgtgcttgttcaggtggttcaacagtgcggaccagagaacaatgcgaggttcaggattaaaggtattctggcttcagaggcagttcttccaaagcaagtgacaggcgattccatcaccggagctaagatcttattacaacattcagaaacacaggagtcctcccaccgcctttcacttcttgcttacttctgcaaccactcgccgtgactgatctccacgcacaccaaagaacacaacacgtggcaagccgatctagcgcgatggaaggaggggggcaaatacagaggaggaataatgccgtgaagcggcacctgcagcagcggcagcaggaggcggatttcctcgacaagaaggtcatcgcgtccacctatttcagcatcgaggcgttcctcgtgctcgcctgcctcaccgtctcgctgctgatactgccgcttgtgctgccgncgctgccggcgccggcgtcgctgctgctgtggctgccggtctggctgctcgaactgctgattgtgcttgccttcatgccgacagatgtgcgcagcatggcctcctcttacttgtaaaaaaatagataaataggccacctttggcaattttctggggtttggaggtg

SEQ ID NO: 205 - DNA, 638 bp, Saccharum officinarum
gattttttccaagccagtgaccggcgattcatcaaccggagctgagatcttatacaacattcagaaacacaggagtcctcgcaccgctttccactcttggctaattttgcaaccactcgccgtgactgatctccacgcacaccaaagaacacaacacgtggcaacccgatctagcgcgatggaaggaggggggcaaatacagaggaggaataatgccgtgaagcggcacctgcagcagcggcagcaggaggcggatttcctcgacaagaaggtcatcgcgtccacctatttcagcatcgaggcgttcctcgtgctcgcctgcctcaccgtctcgctgctgatactgccgctggtgctgccgccgctgccgccgccgccgtcgctgctgctgtggctgccggtctgcctgctcatcctgctgattgtgctggccttcatgccgacagatgtgcgcagcatggcctcctcttacttgtaataaatagataaataggccaccttggtcaatattctgtgatttggaggtgattcgtcctgagatgagtctcgattgatgtcagctactcccaaggggaaatgcatgtaacacttggtggccgacggtggcaagataatcatgctaccatgtcagttaaacc

SEQ ID NO: 206 - DNA, 778 bp, Sorghum bicolor
gctgttggtgttgttcttgagatctctttcttgatcttgtgtgggattaaagagggattcttgccttcctacgggagaaagagaaaaggggaagaacgtgcttgttccggtggttcaacagtgcggagacccggagaacaatgcgaggttcaggattaaaggtgttctggcttcaggtgcagttcttccaaagcaggtgacaggcgattcgatcaccggagctcagatctgacgaaaacaaaacacagtcctcctcccaccgcctttcagttcttgcttacttctgcaaccactcactgcgaccgtacaccaaagaacactgcacatggcaagccgatctagcgcgctggaaggagggggggcagcaatacagcggaggaataatgccgtgaagcggcacctgcagcagcggcagcaggaggcggatttccacgacaagaaggtcatcgcgtccacctacttcagcatcggcgcgttcctggtgctcgcctgcctcaccttctcgctgctcatcctgccgctggtgctgccgccgctgccgccgccgccgtcgctgctgctgtggctgccggtctgcctgctcgtcctgctggttgtgctggccttcatgccgacagatgtgcgcagcgtggcggcctcttacttgtaaatagccagataaataggccaccacctttggccagttttctgtgttttcgggggtgattcgtcctaagatgagtcatgatcgagtgtaatgtgaagcatcttttccaggggtagtagatttcaatgaagt

SEQ ID NO: 207 - DNA, 732 bp, Arabidopsis thaliana
ttgtcttcctcatttccctactagtacttgtttcacacagtttcttgatccaaccaaaaccaatacacaaagcttctcaaactccttcacctcaaagcttcttcctttacatctgaatcgttgagttaactcggatttgttctgcatcctctgtttctgaatcgtgggccatccttattttgtctcgaattcttcaccaattgcttcgatcaagctgcattggttaaccagttgccctaaagatcagatctttgagcaaaattttgtcactgatcttctaaatccaaaccagacacagcaaaacaacctctgtagatgattcgagaaatctcaaacttacaaaaagatattataaacattcaagacagttattcgaacaaccgagtcatggacgtcggaagaaacaaccggaaaaacatgagctttcgaagttcgccggagaaaagcaagcaagagttacggcggagtttctcggcgcagaaaaggatgatgatcccggcgaattatttcagtttagagtctctgttcctattggttggtctaacggcatctctgttaatacttccgttagttttgccgccgttacctccgcctccgtttatgctgctattggttcccattgggattatggttttactcgtcgttcttgccttcatgccttcttctcattctaatgctaatacagatgtaacttgcaatttcatgtaaatctgaaatttattatatgatgat

SEQ ID NO: 208 - DNA, 891 bp, Arabidopsis thaliana
cccactttatttcttcttctctggttttcttaccaaaagaaactttcttcgtcttcctctgtatttaagctttaacaccctgtttttggtttccaacgttcaatcttcatcttcttctcgctgaaggtgtgtttggctctaacggtttaaagctttcttgaaacaccaattgaatcttttctctctaccggcaaaaaaaaaagattagtccttttaggtctggaaacgccaagatcactcgttctaaaccttagattttgtctgcatttcgggataatcatttcatcgtcagggttcttcaaccaaactacatttacagaagaagaagaagaagaaaagttcgttactttttatgcgtttggataaacaaactcaagtttcttcttcatacatcgatctgattttccagatcaaacttcgaaaagagaaaaagccttctttaaatgattcgtgagttctccagtctacaaaacgacatcataaacattcaagaacattattctctcaacaacaacatggacgtgagaggagatcataaccggaaaaacacgagttttcgtggttcagctccagctccgattatggggaagcaagaattgtttcggacattgtcgtcgcagaacagtccaaggaggctaatatcagcgagttacttcagtttagaatcaatggttgtgcttgttggtctcacagcatctctcttgatcttaccgttgattcttccaccattgcctcctcctccttttatgctgcttttgattcctattgggattatggttttgcttatggttcttgctttcatgccttcttctaattccaaacatgtttcttcttcttccacttttatgtaataaacgtttctttaattgaagaaagaaatccttaaacaaa

SEQ ID NO: 209 - DNA, 732 bp, Arabidopsis thaliana; identical to SEQ ID NO: 207

SEQ ID NO: 210 - DNA, 1130 bp, Oryza sativa; identical to SEQ ID NO: 125

SEQ ID NO: 211 - DNA, 2194 bp, Oryza sativa; identical to SEQ ID NO: 117

SEQ ID NO: 212 - DNA, 1104 bp, Oryza sativa
atggatgatcacatgggaagacggacagttggtggccttctcttcaccaaggggggctcaattcttctcttcagagaagacagtgcgcgtcacaaggccaccaattgctgcacgcgacacggttgcagcagcaagcatttggccggcaaagacaagcaaacacacagggcagcaacagcagccaaggaagcatcagaaacccctcggagatcacagattttcaggaaacccagcacgaggactcctcagggaagtactgctactgataacatcagcaggaatgcagcaagctcctatagcgaaaacgacaataggccaagagaaactccagggcgtgatttaatcgctcgtctcaaagagagggtcaatgcatcaagaaaacgatcattgaacagagaaaacagtccatcatcaccaaatggattaagtgctacttcctcaagtagtagccgcacagtctcaagaccgtcgcatcgggcagcttcccgaataaggaaggcagatgaaggtgcaaatgcaggagctgtaaatgtacgcagagacagcagtggagataccaggaggaattcagatagggatgtcgatgatttcttgctagttgagcaggcagcaagagatagcactgaaggattcatatctggattcttggcaagatacagaagtaatcatcagggactactttcatctttggacgacagcatagaggatgcaaatgggtactggcgcttcaatatggaaggaagtgaagagcttgagaactacttcatattcaatgatcggtacagagggatgagaatggacattgacggcatgtcttatgaggaattgctagcattgggagatagaattggcaccgtaagcactggcctttcagaagacgcgctgtccaagtgtctagacagaagcatgtacatggccactacttcaggaactcatgaagattgtgagagaaaatgcagcatatgccaggaggaatattcagatggtgaggaggtgggcaagatggtctgcaaacattactaccacttctcctgcataaagaactggctccggcagaagaactggtgtcccatttgtaaatccgtcgctctgaataccaactag

SEQ ID NO: 213 - protein, 367 aa, Oryza sativa
MDDHMGRRTVGGLLFTKGGSILLFREDSARHKATNCCTRHGCSSKHLAGKDKQTHRAATAAKEASETPRRSQIFRKPSTRTPQGSTATDNISRNAASSYSENDNRPRETPGRDLIARLKERVNASRKRSLNRENSPSSPNGLSATSSSSSRTVSRPSHRAASRIRKADEGANAGAVNVRRDSSGDTRRNSDRDVDDFLLVEQAARDSTEGFISGFLARYRSNHQGLLSSLDDSIEDANGYWRFNMEGSEELENYFIFNDRYRGMRMDIDGMSYEELLALGDRIGTVSTGLSEDALSKCLDRSMYMATTSGTHEDCERKCSICQEEYSDGEEVGKMVCKHYYHFSCIKNWLRQKNWCPICKSVALNTN

SEQ ID NO: 214 - DNA, 990 bp, Oryza sativa
atggatgatcacatgggaagacggacagttggtggccttctcttcaccaaggggggctcaattcttctcttcagagaagacagtgcgcgtcacaaggccaccaattgctgcacgcgacacggttgcagcagcaagcatttggccggcaaagacaagcaaacacacagggcagcaacagcagccaaggaagcatcagaaacccctcggagatcacagattttcaggaaacccagcacgaggactcctcagggaagtactgctactgataacatcagcaggaatgcagcaagctcctatagcgaaaacgacaataggccaagagaaactccagggcgtgatttaatcgctcgtctcaaagagagggtcaatgcatcaagaaaacgatcattgaacagagaaaacagtccatcatcaccaaatggattaagtgctacttcctcaagtagtagccgcacagtctcaagaccgtcgcatcgggcagcttcccgaataaggaaggcagatgaaggtgcaaatgcaggagctgtaaatgtacgcagagacagcagtggagataccaggaggaattcagatagggatgtcgatgatttcttgctagttgagcaggcagcaagagatagcactgaaggattcatatctggattcttggcaagatacagaagtaatcatcagggactactttcatctttggacgacagcatagaggatgcaaatgggtactggcgcttcaatatggaaggaagtgaagagcttgagaactacttcatattcaatgatcggtacagagggatgagaatggacattgacggcatgtcttatgaggaattgctagcattgggagatagaattggcaccgtaagcactggcctttcagaagacgcgctgtccaagtgtctagacagaagcatgtacatggccactacttcaggaactcatgaagattgtgagagaaaatgcagcatatgccaggcaagaatattcagatggtga

SEQ ID NO: 215 - protein, 329 aa, Oryza sativa
MDDHMGRRTVGGLLFTKGGSILLFREDSARHKATNCCTRHGCSSKHLAGKDKQTHRAATAAKEASETPRRSQIFRKPSTRTPQGSTATDNISRNAASSYSENDNRPRETPGRDLIARLKERVNASRKRSLNRENSPSSPNGLSATSSSSSRTVSRPSHRAASRIRKADEGANAGAVNVRRDSSGDTRRNSDRDVDDFLLVEQAARDSTEGFISGFLARYRSNHQGLLSSLDDSIEDANGYWRFNMEGSEELENYFIFNDRYRGMRMDIDGMSYEELLALGDRIGTVSTGLSEDALSKCLDRSMYMATTSGTHEDCERKCSICQARIFRW

SEQ ID NO: 216 - DNA, 1743 bp, Oryza sativa
atggaggattatccaagtgggagatcaaaagcagctattggatttctcagaagaggtggtggtttctcttcgagaaatcaaagcactgaagagaggaccattcagaactatgatggaccaggaatcaccacaagactcaatccgatgaaaaccaggctgtctgataatcaggagagaccaagatacctacgtgactcattcagatcttcaacctcaatggccattcatggaagctcttccaaagttccgcttaggaaattcggtgacgaaaaacgaaggcaaacgttgttggcaggggtagacattgctgaaagtagcagcagaaatgctgggggcaaacatctggagggtagtaataagagaatcgttgtcgatgataggagttcagatgttctgcatactgaaacagaaggcttggctactgaacaagaccaattgatagcacccaatgctggagtttctgattctgctagttcgtcagatatttctgaacatgcagttgaatccttggtaaggagtgctgctccaagttctagaacccgtagacagaaggacaaagaattgaatttgggtcaatcaggagtttgctcttcgtcatgtactaacaggcctactatatcaagatatgctcctgccgatgtgaagcgaccgtgtaatcatgctagcggagtacaacagcatggtcataacaatctggactgtacttcagtacctaattttctgccatcaggttgctcatctggttctgtttatagcaggaggtttgatgcaatgagaaaaaggacttctgatgggggaagtttttctagatcaaggggcttaagtggaacggctagcttagacgattcacctcctgcataccctgccattgctggtcctagaatcagaacaactacaactgaacgggcttcacaacaaaatgcactaagaagcagaaggaattttcaggattcagcagtgtcagtaaggacaagaagacctccttggggtgctaggttcaggatctctgaggaaagagaggatggcatgatttctcagcgtgattcttccatagggaatcaacagtcagatcaggtgcattcatcttcggaagaggcctctacagagagctcctcaagaccattctctgcagaattacctcatgcaatttactcatctagaggagagggatcaaatgctttcactgcaaggagaagaagatcaagctccctttatgaggaaagacctccacagacattccatgatcttttcagagaaagaaatggccgaagacacatatccatagaaggaattgcagaggtattactagctctggacaggattgaacaagaagcagaactgacttatgagcaattgatggtgttggagacaaatatattgcttggtgctttcacctcccatgatcagcatagtgacatgcgcatggatatcgacaacatgtcctatgaggaattattagcattaggagacagaataggctctgttagcaccgctctttctgaggagcaatttgtgaaatgcctcagaagaagtatatatataccagtggctacaaaagcaaacgcgcaagttgtagacgacatcaaatgcagcatatgccaggaggagtacatagagggtgaagaagttggacggctgggatgtgagcatcagtaccatgtgtgctgcattcaccagtggctcaggcagaagaactggtgtccaatatgcaaagcttcagctgaaccttctactgtgagctaa

SEQ ID NO: 217 - protein, 580 aa, Oryza sativa
MEDYPSGRSKAAIGFLRRGGGFSSRNQSTEERTIQNYDGPGITTRLNPMKTRLSDNQERPRYLRDSFRSSTSMAIHGSSSKVPLRKFGDEKRRQTLLAGVDIAESSSRNAGGKHLEGSNKRIVVDDRSSDVLHTETEGLATEQDQLIAPNAGVSDSASSSDISEHAVESLVRSAAPSSRTRRQKDKELNLGQSGVCSSSCTNRPTISRYAPADVKRPCNHASGVQQHGHNNLDCTSVPNFLPSGCSSGSVYSRRFDAMRKRTSDGGSFSRSRGLSGTASLDDSPPAYPAIAGPRIRTTTTERASQQNALRSRRNFQDSAVSVRTRRPPWGARFRISEEREDGMISQRDSSIGNQQSDQVHSSSEEASTESSSRPFSAELPHAIYSSRGEGSNAFTARRRRSSSLYEERPPQTFHDLFRERNGRRHISIEGIAEVLLALDRIEQEAELTYEQLMVLETNILLGAFTSHDQHSDMRMDIDNMSYEELLALGDRIGSVSTALSEEQFVKCLRRSIYIPVATKANAQVVDDIKCSICQEEYIEGEEVGRLGCEHQYHVCCIHQWLRQKNWCPICKASAEPSTVS

SEQ ID NO: 218 - DNA, 2130 bp, Oryza sativa
atgcatcaacataggatcactatgctatcttcctcagaaacatgtcaccttggttctagttcgaacaaccaagccatggatcagcagaatttactgcccagcaaccccaccgcagatgaacagaatttacttccaaatactctagaggatgatgattacccacattatttacttggtagtcatgaggtggaaatgccaaatggaagcgtgattggtcagcaaaatacaagcttgaacttatgggattcagctggatctagctcgatgggctgtgtagctgatcatgatagtctttttgaggccaaaagggaacattttgctcctgctttgtctatccgagctcccttaattattggagggagaagacatgaaggcagtagttcattgccttcacagagcttaaacttagaccttaatcttaatcaggctgatcagtttgattctgaggatgttgatatgattcagagtaatggacaaccagggataaacgcttttcctctcaacaggggcctttccattcctgagcatgttctgcgccatacaaattcttccagtgctacaggaaatccttcacaggttgcaagcttttctgatggaatgacaggccaagaagttaacctgtttggtgggcatcgttcatcttgcaagagaaagaatattgatgggagtcttgcagagtcttctgccaatggtagttcacgtaataatcagcgaaataatattatactggaaccttctccatccagtcatgaaagcacttctggtttaactgcacctgcccctacaaaccatgttttttcatactctcctgtggaacagctaaaccagaataccaatatgtctgcaaatgctatgttgtctgatcattattcactatatggtgatcatgagcgtgagagatttctgaggaatacccggatgagaacaagccctaatgagtatgatcaatcatcgtccaatctcttgcctgaaggaagtctcaggtgttctgtttatcagcctactcagcaacagtctttgtttattccagtacaacctagagcatcgagctcttcaacaagttctcttagtcggccttatgtgcctgctgtcactcaattctcacaaaatttgcaccgtgctccatcaagtggcaattttggttcgagaatagggatttttcctagttctgctgatacaacaaaccagttatcttcacaagatcccaacaggagctcggtgagaggcaattttcctgagccccttctgttaggttcttctctgtttccttctgactcggcagaattgctatctatgccgggaggcagaagcaaccaacaaaattccagctccacaattcgaactgctgtaaatataggagctcaacagattgctgggttaaatgcatcccagcctacttcaagctcaaggggttcggttgatattgttaggagatccttgcaggctgctagcgttcctcagtccagaggttcaagcattacatcacagcagcaacgtgggcattcatccacatcacatgagattcgaagccatcaacctggatccagctctcgtgccaatcagcagcattatgtcagggctgttcctcactctgtagataggcaaaactcgaattacttggacctgcagtcttttatgcaaagcattgctgcttcaagagacggaattaggacagtctcagagtctgccaatcaacttgtgcatcttcgcaatgttgttgaacaaattcgtcagggaagaggtggaaggtttgaggatcctaattttgaacgtgcactttttgcaaggcgtgccagtttaattgacagacatcgtgacatgcggcttgatgtggataatatgtcatatgaggaattgttggcacttggtgaacgcattgggtatgtaaacactggacttagtgaggataaaattaggactggtttgaagcaatggaaatatgtgagcataccgattgaagaacctctaactggtgttgaaccatgctgtatttgccaggaagaatatgccgaaggtgaggacatgggcagactagactgtgggcatgacttccacaccgcatgcatcaaacaatggctggttataaaaaatctgtgccctatctgtaaaaagacaggactgggcacttaa

SEQ ID NO: 219 - protein, 709 aa, Oryza sativa
MHQHRITMLSSSETCHLGSSSNNQAMDQQNLLPSNPTADEQNLLPNTLEDDDYPHYLLGSHEVEMPNGSVIGQQNTSLNLWDSAGSSSMGCVADHDSLFEAKREHFAPALSIRAPLIIGGRRHEGSSSLPSQSLNLDLNLNQADQFDSEDVDMIQSNGQPGINAFPLNRGLSIPEHVLRHTNSSSATGNPSQVASFSDGMTGQEVNLFGGHRSSCKRKNIDGSLAESSANGSSRNNQRNNIILEPSPSSHESTSGLTAPAPTNHVFSYSPVEQLNQNTNMSANAMLSDHYSLYGDHERERFLRNTRMRTSPNEYDQSSSNLLPEGSLRCSVYQPTQQQSLFIPVQPRASSSSTSSLSRPYVPAVTQFSQNLHRAPSSGNFGSRIGIFPSSADTTNQLSSQDPNRSSVRGNFPEPLLLGSSLFPSDSAELLSMPGGRSNQQNSSSTIRTAVNIGAQQIAGLNASQPTSSSRGSVDIVRRSLQAASVPQSRGSSITSQQQRGHSSTSHEIRSHQPGSSSRANQQHYVRAVPHSVDRQNSNYLDLQSFMQSIAASRDGIRTVSESANQLVHLRNVVEQIRQGRGGRFEDPNFERALFARRASLIDRHRDMRLDVDNMSYEELLALGERIGYVNTGLSEDKIRTGLKQWKYVSIPIEEPLTGVEPCCICQEEYAEGEDMGRLDCGHDFHTACIKQWLVIKNLCPICKKTGLGT

SEQ ID NO: 220 - DNA, 1506 bp, Oryza sativa
atggctagacaccatggaaaccattccctactgccagagatggttcaacccaataatgagcaactcaaccaacctctgcctttaggtcagaagttatttgtgcatgctggaaatgatgcagcccttaaaattggcccttcataccatgggaatgtggcaattagatcgaatgatcttccatcttcaagtcgagtggcacaatattcaggtcatagagttaaaaacacaggaaccttacataactcctatgttcactatcctgctggaagctctggtggccatgtatcctacaatcctcaaactgaacctgttataacttatccacatagatctgagggagaatttgctcgagggagttcccaaatcgacaacagaactgctgcagtgaaacgaaaaaatcctgtcatttatccagagtatagcatcaatggtgatggttattgtgccggtagctcatcaagtacccagttctctaattatccacagccagctccattttctgagtccttgcatcgtcaaatgcctccaagtgttggcccaattaattggaatgaccagagcttggtaaatcaagaaggaagtcagagaaatgtgagggcacgtcataattttaataatatttcattggaacctagaccagtccattctacttcgaatgtttcccaaagtacatcaatgaaaaggaatggaccatccttttctacgcgaatgagaactatgccttcaggtgcctctggaatgcactctggagaaatgccttacactatgggaagcagcaactcatctgttcctgtcccaactttacaaggctcttcaagcagtgcaatatttgccagtggtgtctttgcacctaggcatgttcatggtgacactgttcctagctacattcatctgccttctgtagcatcctctagctctacagcgattccccatgaggtgatcattccgagctaccaacctgctacctctgcaactacctcaacacccatgagggccagtcagccattacctgtcagagctgttgcatcttctagacatgcaaggaatgtactcatagggcatgctaacagcggaaggaacagaagggcgagaagctcatactatggtattcagcctttgatgattgatgcacagcaattgataatgatgcaacaatttgctctccgcgaatcaagagaagcacaagacccccacagggccatgagactggacattgacaatatgagttatgaggacctgctggctttgggagaatctattggtaatgtctgcacaggcttggtggacgagaaaatctcaggttgtgtgagagaagtgatctattgcagttctgatgaacagcaaaatgatcaagatgatgggaaatgtgcaatttgtctggaggaatacaaagacaacagtttgctgggaatactgaaatgcaatcacgacttccacaccgactgcgtcaagaagtggttgaaggagaagaactcatgcccaatttgcaagtcggctgctgcatag

SEQ ID NO: 221 - protein, 501 aa, Oryza sativa
MARHHGNHSLLPEMVQPNNEQLNQPLPLGQKLFVHAGNDAALKIGPSYHGNVAIRSNDLPSSSRVAQYSGHRVKNTGTLHNSYVHYPAGSSGGHVSYNPQTEPVITYPHRSEGEFARGSSQIDNRTAAVKRKNPVIYPEYSINGDGYCAGSSSSTQFSNYPQPAPFSESLHRQMPPSVGPINWNDQSLVNQEGSQRNVRARHNFNNISLEPRPVHSTSNVSQSTSMKRNGPSFSTRMRTMPSGASGMHSGEMPYTMGSSNSSVPVPTLQGSSSSAIFASGVFAPRHVHGDTVPSYIHLPSVASSSSTAIPHEVIIPSYQPATSATTSTPMRASQPLPVRAVASSRHARNVLIGHANSGRNRRARSSYYGIQPLMIDAQQLIMMQQFALRESREAQDPHRAMRLDIDNMSYEDLLALGESIGNVCTGLVDEKISGCVREVIYCSSDEQQNDQDDGKCAICLEEYKDNSLLGILKCNHDFHTDCVKKWLKEKNSCPICKSAAA

SEQ ID NO: 222 - DNA, 1095 bp, Oryza sativa
atggctcgccgcgacggcgtcggcggcgacggcggcgcgtcggcggcggagcagcagcggagagtagcgctgcgtgtgctgctgtcccgtgcggaggcttcctcgccgccgccggcgacggtggaggaggaggcgcagcgggggaggagcggtggtggtaacaaggggctcgcgtcggcggcgctgcgcgggctcgggtgcacgtcgacggcggcgctgcgtgcccacgcgccggcttcggcggtggaggtggcgagtagctcggagcggtggcacgggaggcggcggcggaggaaggtgcaggagaggcggagcgcgaggggcggcggcggaggaggaggaggaggcgtggcgccgcccggccccgcgccggcggcggccggggacgtgtggtgcacgtgcgctcccgggataccgttcgccgccgaggcgtcgtcggtggactgcgtcgtggtggcgcgccaccaccacgcccaccacacggcggcggcgatgggctccggccgccgcggggaggcggagcggcgccacagagagaggccggccgctcctcgagctcgaagggtgaccatgcgtgagcacatatcctcgtcgctcatggactcgccgccgttccccgacatgccgctcctcaacgccgacctgctaccaccaccaccctccggccgccaccgccatggataccgccacccccacgtcggcgccgccgaggaagagatcatgatgttaagaacacggctattatggggaagattcggtatgcatgatcagcaccaggattggcgactcgacgttgacaacatgacatatgaggagctgctggatcttgaagacagaattgggtatgtaagcacagggttgcatgacgatgaaatcgctcgcagccttaggatggtcaagtattcagcattcaaccccaagcattttgcaacagaagtagaaaggaattgcagtatttgtcaggaagaatttgaagcaaatgaggaaacagggaggctgatctgtggccacagctatcatgtgcaatgcataaagcagtggctttctaggaagaacacctgccctgtctgcaaaactgttgtatcgaagacatga

SEQ ID NO: 223 - protein, 364 aa, Oryza sativa
MARRDGVGGDGGASAAEQQRRVALRVLLSRAEASSPPPATVEEEAQRGRSGGGNKGLASAALRGLGCTSTAALRAHAPASAVEVASSSERWHGRRRRRKVQERRSARGGGGGGGGGVAPPGPAPAAAGDVWCTCAPGIPFAAEASSVDCVVVARHHHAHHTAAAMGSGRRGEAERRHRERPAAPRARRVTMREHISSSLMDSPPFPDMPLLNADLLPPPPSGRHRHGYRHPHVGAAEEEIMMLRTRLLWGRFGMHDQHQDWRLDVDNMTYEELLDLEDRIGYVSTGLHDDEIARSLRMVKYSAFNPKHFATEVERNCSICQEEFEANEETGRLICGHSYHVQCIKQWLSRKNTCPVCKTVVSKT

SEQ ID NO: 224 - DNA, 1602 bp, Oryza sativa
atggctggacatcagtataataattcccagatgtcccggatggatcatatggacaggctaaacaatgaacctccaccttttggccaaaagttatttatgcatcctaggagtgatccagctaacggagctggatcgtctggctatgtgggtaacacaatgagatcgaatgatcttccgtcttcaagttatgctggccaagcttatggtcagcagaatagagcccccatccatgcttcatattctggtcatgcacctgctggaagctctagtggtagctatgcaccatacaatactcaacatatgcctgcttcaagctatccacacggatccgaggataatttcattccaagttcccatgtggatggcagaagggttgcattgaagagaagaaatcccatcattcatcctacagatggattcggtgttggaaattattatgctggcagttcttccaatactcagttctctcggcccatgcctccaaatcctattccacctcctgaatcctgtgttcgaatgccctcacacttgggttcgaaccactggaatgatcaccgctatgttaatcatgaaggatctcagaggaatgtgaggggaagacatgatcatagtactatccatttggaacaaagtccagctgcagcttgcccgtcaagcagcatcaatgtgccaccataccatccaaatgcaaatggtccttttggaagtgcaccagtacaacgtgacagagctcctttatctgtgcatccaagaattcttcctccagggcctgatggtagtagcatagcattcagagagaggccatactatcctgctccacagagcaccaacataagtgcacctgtgccaacgcttcctatttcttgtgacagtgcaccatttgctcatggtgggtacgcccctagatcagctcatcgtaacaacttacgcacttatcctcctccagcttttgcatcttcttccaaccctggagcagtctcccatgagccagctattcctagctatccacctgctgcccctagctatccacctgcaacctctgcagcatcatcaagtgtccagccatttcatgctgaagctgctgcacatttgaggcatccaaggcatgtatctgtagggggcagtggtagtgcaaggagtagaaggatgagggattcctatcatggttttcatcatttgatgattgaagacaataacttgggaagatcagcagctgagcggtttatgatgctggatcagttagttatccatgaatcaagagaagcattcgatcctcactgggacatgagactggacattgatgacatgagctatgaggagctgctggctttggaagaacgcataggccatgtgaacactggcctcgctgatgagaaaatttctggctgtgtgatggaggtagcctgctgcagcagtagtcatttgcaggatgatcaggacaatgaaagatgtgtaatctgcctggaggaatacaagcatgaggacacacttgggaggctgaaatgcggccacgggtttcactgcaattgcatcaagaagtggctgcaggtgaagaacacctgcccagtttgcaaagctgctgccgcagatgaaggcagctga

SEQ ID NO: 225 - protein, 533 aa, Oryza sativa
MAGHQYNNSQMSRMDHMDRLNNEPPPFGQKLFMHPRSDPANGAGSSGYVGNTMRSNDLPSSSYAGQAYGQQNRAPIHASYSGHAPAGSSSGSYAPYNTQHMPASSYPHGSEDNFIPSSHVDGRRVALKRRNPIIHPTDGFGVGNYYAGSSSNTQFSRPMPPNPIPPPESCVRMPSHLGSNHWNDHRYVNHEGSQRNVRGRHDHSTIHLEQSPAAACPSSSINVPPYHPNANGPFGSAPVQRDRAPLSVHPRILPPGPDGSSIAFRERPYYPAPQSTNISAPVPTLPISCDSAPFAHGGYAPRSAHRNNLRTYPPPAFASSSNPGAVSHEPAIPSYPPAAPSYPPATSAASSSVQPFHAEAAAHLRHPRHVSVGGSGSARSRRMRDSYHGFHHLMIEDNNLGRSAAERFMMLDQLVIHESREAFDPHWDMRLDIDDMSYEELLALEERIGHVNTGLADEKISGCVMEVACCSSSHLQDDQDNERCVICLEEYKHEDTLGRLKCGHGFHCNCIKKWLQVKNTCPVCKAAAADEGS

SEQ ID NO: 226 - DNA, 1503 bp, Oryza sativa
atgttacaaagaaatatggtgtggacacatcaagttgccagtcctgaaaaccaagttcaacctgaaagtttctatcatggaggtgctgggagcaacttatctaacctgagtgtgcaagttgctgttggagttccaggaaatactgatttccggagtcactatgagagcattaatcttcagcaccagcatgttcagaatccatacccacatgtgggtgttgcttcaagttctgtgttcccatctactatgtacaacccctgcatatcaacaacagcagtggacagatatgttcctcctattcaaagttttggattgggcaatccactactactgcctttatatcatcaacttgctcaaggatccatggatgagaacggcagcagtggcaatttttgtgacagcgtcagggaatttatcaagaggaaaaatgcattacttgtgggtggccatcattttgttaatagttttgcaagctcaagctcatctgcttatgtgcctccaaatcctttacataggtcatggaacgcttcatttgaagcaaatatcctacccagcactggagtttccaatccaccagagtactcttctgcagattcactgaacaattccaattcgatggcttcacatccagaattggtgcatcatggcaattatgtatttccagctggtcacatgagccaatacaatgcatggattgcacaggcaagcagaactggtggagtaccacagtgggaacatggcaatgcagcggctaatcctccaggtggatttgttcattctggaaccatagacatgccaaatggaggtcttcagggataccaagctggcccttttgccaattattatgggcctctgccccatttccaccaaaatcctctgaatagcatgcagcatcctgctctatttaatcatatccaaatgcaagtacctcatcaacattgcctcagtaacaatttattgcatcacccttctggcaatggcctccccttggatccaagaattctggcaatttcatccaattctgggcatacctttgggcctacagctcagccatctttagcaaaccaagttaatgctgggagttcgagaattcagccatatgagaatgctccgttcgtggatctttcgagattgtatgaagcaggagttattgatgaacatagagatatgcggcttgatgtagacagcatgacttatgaggagcttgtagcgttggaggagcggattggaaatgttaatagtggttttacagaaagctacattgaggaaaatttgaagtcaagttcttatgtcccggacgctgattgcatgcctgatcagtcttctgtggagaaggatgcttgcataatctgccaggaggaatatgaggctaaagaactcgttggaacccttggttgtggtcacaagtaccatgcgatgtgcataaaagggtggctgatggtgaagaacctgtgccccatctgcaaaacaacagctttgccagctgatagaagaaacggatga

SEQ ID NO: 227 - protein, 500 aa, Oryza sativa
MLQRNMVWTHQVASPENQVQPESFYHGGAGSNLSNLSVQVAVGVPGNTDFRSHYESINLQHQHVQNPYPHVGVASSSVFPSTMYNPCISTTAVDRYVPPIQSFGLGNPLLLPLYHQLAQGSMDENGSSGNFCDSVREFIKRKNALLVGGHHFVNSFASSSSSAYVPPNPLHRSWNASFEANILPSTGVSNPPEYSSADSLNNSNSMASHPELVHHGNYVFPAGHMSQYNAWIAQASRTGGVPQWEHGNAAANPPGGFVHSGTIDMPNGGLQGYQAGPFANYYGPLPHFHQNPLNSMQHPALFNHIQMQVPHQHCLSNNLLHHPSGNGLPLDPRILAISSNSGHTFGPTAQPSLANQVNAGSSRIQPYENAPFVDLSRLYEAGVIDEHRDMRLDVDSMTYEELVALEERIGNVNSGFTESYIEENLKSSSYVPDADCMPDQSSVEKDACIICQEEYEAKELVGTLGCGHKYHAMCIKGWLMVKNLCPICKTTALPADRRNG

SEQ ID NO: 228 - DNA, 918 bp, Oryza sativa
atggacgccgccaaggataccaccgccgccgccgccgaccaaaaccctacccccaaccctcccaccgccgcagctccacccgatgactccgcggcggcggcggcggcggggagacggcccttcaccagcctcacccaggaggaggccgacctcgccctcgcccgcgtcctccaggagcaggagcgggcgtacatgatgctcagcgcgcaccacggcggcgactacgcggcctccgatggtgggagctacgagtttgacgaggaaggggaggggagcgattttgaggacgaggatggggacggggacggcgacggggaggcgctggatgaggacgaggaggtggccgacgcagacgcagacgccgccggtgacccggctgagttggaccccgcgcggtacgaggacgacgaggccttcgcgcgggcgctgcaggacgccgaggagcgcgaggtcgccggccgcctcatggcgctcgcgggcctcagtgattggcgagtgatggaccatgatgatgacgatgttgatgatgatgatgatgaggatgatgatgatgatgatgatgatgaagatgaagacggggatgatccacaggatgcatgggaagatgttgatccagatgaatattcttatgaggagctggttgcattgggtgaagtagttggtacggaaagcagaggcctctctgctgatacacttgcttcattaccttcaataacttatcgagcacaagataagcaagacggcaacatggaacaatgtgttatttgccgtgtggaatttgaggaaggtgaatcattggttgcacttccttgcaagcattcataccattctgaatgcataaaccaatggctgcaattaaataaggtatgccctatgtgcagtgctgaagttcctacttcacaggacacccgggcatga

SEQ ID NO: 229 - protein, 305 aa, Oryza sativa
MDAAKDTTAAAADQNPTPNPPTAAAPPDDSAAAAAAGRRPFTSLTQEEADLALARVLQEQERAYMMLSAHHGGDYAASDGGSYEFDEEGEGSDFEDEDGDGDGDGEALDEDEEVADADADAAGDPAELDPARYEDDEAFARALQDAEEREVAGRLMALAGLSDWRVMDHDDDDVDDDDDEDDDDDDDDEDEDGDDPQDAWEDVDPDEYSYEELVALGEVVGTESRGLSADTLASLPSITYRAQDKQDGNMEQCVICRVEFEEGESLVALPCKHSYHSECINQWLQLNKVCPMCSAEVPTSQDTRA

SEQ ID NO: 230 - DNA, 770 bp, Zea mays
  misc_feature (502)..(514): n is a, c, g, or t
  misc_feature (544)..(562): n is a, c, g, or t
  misc_feature (634)..(667): n is a, c, g, or t
ggactgtacaggacaacagaatttgctgttttcaccgagatctacagacagcgtgactggagtttggatttcaattcttgctgacggcagtcttgcaaactgggcaaatgttcttctgcgagagccactgcttgatgcagtacacatggtagctatggccacagtctagccttcccatctcttcatttgtttcaaattcttcttggcaaatgctgcattttctttccatttctgttgcgaaccgtaaggaactgaaggatgggtgcttgaccttccgaaggttgcgagtaatctcgtcgtcacgtaaccctgtgttgacatatccaattttgtctccaagctcgagcaactcctcgtatgtcatgttatcaacgtcaaggcgccaatcctggtagcggtcatacatgttcattcctcccagtaacactcttgtctgaaacatccttatctcttcctcgagtcctccggcgctctaccgtgagccgcgggtcccctgacatgnnnnnnnnnnnnngagatcggcgccgaataaggcgacatcgcnnnnnnnnnnnnnnnnnnngtccatgaaggacgaggatatctgctcctgcacggtcaccctccgggacaagcacggcctctctctgtgggnnnnnnnnnnnnnnnnnnnnnnnnnnnnnnnnnncaacatctggtggcgcgccaccacgcagttcacggaggacgcctccgccgcgaagggtatgccgggtgcgcaccacacgtcggcgccgatcccaccggtgacg

SEQ ID NO: 231 - protein, 123 aa, Zea mays
MFQTRVLLGGMNMYDRYQDWRLDVDNMTYEELLELGDKIGYVNTGLRDDEITRNLRKVKHPSFSSLRFATEMERKCSICQEEFETNEEMGRLDCGHSYHVYCIKQWLSQKNICPVCKTAVSKN

SEQ ID NO: 232 - DNA, 814 bp, Zea mays
  misc_feature (759)..(759): n is a, c, g, or t
gcacgagcgatggtgtttggggtgttcctttatcaacaaggggtagagaaggaagaaggttaatggagattcggaatgcacttgaaatgatccatagaggggagaatgtaaggcttgagtctatcttctatggcggtgttgacattcacgatagacacagggacatgcgccttgacattgacaatatgtcctatgaggagctattagcactcgaggaaagaataggaaatgttggcactggcctcagtgaggaagctgtgataaggttgctcaaacaaaggaaattttcatcttggacactaaaagcatctttggaccctgaaccatgttgtatctgccaggaggagtacgctgatggagacgacctcgggaggctggactgcgggcacgacttccacgctggctgcatcaagcaatggctggtggtgaagaacgtgtgccccatctgcaagagcaccgcattgaagaagacctgaaacccgaacaaaggctcgtgtcagagacacccccccatgtttctatgttcactcgatcgttcgcgagatcctttgccgattcgtattgctacgttttttttggtcgggaaaattttgccagacacctgcatgctattgggaaaggaaaagagagagaaaaagagagagagagagaggatgcggttgcggtcctctgtaaactgctgctgcagtaaataatccctggaatatgtctccctgcatccaaccaaatatttagtagctgttatagtggacgccgtangattaaaacctggaagagagcctgttggctgttgcccacaaaaaaaaaaaaaaaa

SEQ ID NO: 233 - protein, 137 aa, Zea mays
MEIRNALEMIHRGENVRLESIFYGGVDIHDRHRDMRLDIDNMSYEELLALEERIGNVGTGLSEEAVIRLLKQRKFSSWTLKASLDPEPCCICQEEYADGDDLGRLDCGHDFHAGCIKQWLVVKNVCPICKSTALKKT

SEQ ID NO: 234 - DNA, 2276 bp, Hordeum vulgare
gagggaatccgagcccggaagcgcccccacacccacaccctcccctcctcctcgccgtctcctcccattccggccccgccgccgcgaccacgaggcacggcctcccattccggccccgccggcgctcgcgcgctccctctccgtcttcctgatccgaggcttcccggaccggaatgcgccgccgctgttatatttcttattgatccttgcaaatcgtggttacagaactacttgacatcggagaattttttttcttctcggtatttagcgacatctggttacatggaggagtatttaagtaggagatccagaacagcaattgggtttctcaggagaggttcaggcataaatcgaagccctgaagagacaatcagtcagaacactgaggtacagggacgcacttcaagagtcaatcctatgaaaaccaggctggttgataatcaggagagacccagatatttacatggctcgtataaatatgcaagctcaaatgtcatgtctggaagctcttccaaatttcctaagaaatttccccttagaaaatttggtgaggaaaagcgaaggcagactttgttggaaggggctgacgttgctgaaagtagtagaagaaagtccgatgtcgggtgtctggagggtagtaagaaaaccattgtagagaatcagggttcagatgctccacagactgagacagaaggattaactgccaaagatgatgaactgatagcacccgatcctgaggtttcacattctgctggttcttcaggtatacctgcacatacagatggatccctgataaggagcgcctcactaagttctgaaacacatagacagaagaataaggaattgaatttgggcagacctggatattcttgctcttcgtcatttagtaatcagcctactatacctagaattcccaccgttggtgcaaagccatcatatggtcttgttagtggagaacaaagacgtgtaccacgtggtcttaaaaaccttggttgcacttcagtctctgatgttctgccatcaggatgttcatctgattctgtatatagaatgagcttcgatgctatgagaaagagagcttctgatggggatggctcttccagatcaagattcataagtggaccatccagtttaggtcattcacatacaatatatcctagcattagtggtcccagaatcagaactaccgaagaatcagttcggcaacaaaaattacgaagccgcagcagaaatattcaggattcagcagtatcagtaaggacaagacggacttctcctcgagacactaggttcaggatgtccgaggaaacagaggattccgtgcttcatctgaatgagtctaacgccgggaatcaacagtcagtcggtgctgatttttctgtggaagagggttcttcagaacgctccataagaccagtctctgtggaactacctcatgcaatttactcatctagtcgtcagggatcgagtactcggactgccaggagaacatcgacctctcgttttgagcaaagccccccacaaacatttcgcagtctggcgagggaaagaggtggccacagacgcataaacatggaaggcattgcagaggtattgctagtgctggagaggattgaacaagaagctgagcttacttatgagcaattgcgggtactggagacaaatctgttacttggtgcctttacctcccatgaccaccatagcgacatgcggatggatattgacaacatgtcctatgaggaactattagcattagaagagagaataggattcgtaagtactgctctttctgaagaacagtttgcgaaatgtatcagaaggcgtttatatagaccagttgctgcaaagggaaacaaaacagccatagatgacatcaaatgcagcatatgccaggaggagttcgtgaagggcgaagaggttggcaggttgcggtgcgagcaccagtaccatgtgtgctgcattcgccagtggctcctgcagaagaactggtgcccagtctgcaaagctccagcgttgccctctatgaactgagccgaacatcatgtaggagccgaggtctcgaacctgtaaaataaattactatgcgatgtgatggggtagtcgtggctcgtggacctgtgaataatcttggccggggttcactccagtttgtgaatgtcaaatggatttgtgccctgtgaagtgtgagctgtgaagagtccagcttgtgaatgccaaactgttatcagttgcactaaagttatacttgtgtctttttgccaaaaaaaaaaaaaaaa

SEQ ID NO: 235 - protein, 582 aa, Hordeum vulgare
MEEYLSRRSRTAIGFLRRGSGINRSPEETISQNTEVQGRTSRVNPMKTRLVDNQERPRYLHGSYKYASSNVMSGSSSKFPKKFPLRKFGEEKRRQTLLEGADVAESSRRKSDVGCLEGSKKTIVENQGSDAPQTETEGLTAKDDELIAPDPEVSHSAGSSGIPAHTDGSLIRSASLSSETHRQKNKELNLGRPGYSCSSSFSNQPTIPRIPTVGAKPSYGLVSGEQRRVPRGLKNLGCTSVSDVLPSGCSSDSVYRMSFDAMRKRASDGDGSSRSRFISGPSSLGHSHTIYPSISGPRIRTTEESVRQQKLRSRSRNIQDSAVSVRTRRTSPRDTRFRMSEETEDSVLHLNESNAGNQQSVGADFSVEEGSSERSIRPVSVELPHAIYSSSRQGSSTRTARRTSTSRFEQSPPQTFRSLARERGGHRRINMEGIAEVLLVLERIEQEAELTYEQLRVLETNLLLGAFTSHDHHSDMRMDIDNMSYEELLALEERIGFVSTALSEEQFAKCIRRRLYRPVAAKGNKTAIDDIKCSICQEEFVKGEEVGRLRCEHQYHVCCIRQWLLQKNWCPVCKAPALPSMN

SEQ ID NO: 236 - DNA, 2688 bp, Hordeum vulgare
ggagctctcccccgtctttctcttctcccctggtctttggcagattttcctccacccgttcgctccttccctccctccctcctctccttctccctaccgcccgcccgcatcgatctctccgaattctgtccccccacctagctgccatccgtctccctccaccgattgactggcttttcctccgtttcttggggctgattcttccctccatctctcttggctggagaggatcggcaggagaaggaaccaaggtggatgccaagaagtttgatgcctgcttggaggattctggttcttccggcgagccgttgaacatctcgggaccggcccctcccacggtctcacttgaaccgctggagaagaggcgagcagcatctgacatgctattgctgcagaacgatctgtagaaggacacccctttaccctttcgataatgcaagggcagaggaattccgtcgaacagctggctgacgtctttggattcgaccatgggtctggttcaggcaaccctgtcatggaccagcaggcgtactggaacagcatgcttggagcagcagaatctcagaacctccaaggttacgagatgaaccgcggtgacggggccattccgtatggaggcgaggggcatcaagacggacagttcttgggtttctgggggtcaggtgaagctagttcgagcggcaatgcgctgaacattggtggtggtttgaggatcggtgaaaggcgcctgggtgctgaacacagcctttctttggataatgtggatatcaaccttaacgccagtggccatgatctctttggtcagagctcaaatgcgaatgccacctctcaagcctcacagcaaaatgctggatgttcccgtgctgataccacagcccaggctactgagcttagattgcatccttacagaactttcggtttagacgacgagcagccagagccgttcccttctttgaatgctttcgaacatcctttggggaatttctccctgatgccagaggacattgatcaaagaccaggcagttccctggacggccggcgtttagcgtgcaagaggaaaaacattgaaggagtccatgggcagttttcagcaggtgctagcacaagcttttcccacagaaatgataatgccttccatagtgttccttcttcaagtttcaatccagctcctggcccaaatgtgtcctctcataacttcttgttagctccaagttccattgaggaacaactcccgaactatggaactactacaggaatgtcatctgttagctacaatcctcctagtggaggcaataacagttcaggaaattcacagagaagttttcgggcaagaactacaaccgctcagcaggttagcccctatggtgtatggccctcttcaggttctatcaggcatccaggttcatattaccaccaggcgcctgcctttcagagcgcatttgatgaactagaagcggctatgcctgtggtcagtggaatcaacttgcaataccagcatcctggaaatgtagtccctggcattccacaaactgcacagcgtttcgctggtcgagcagcggcttcatcgtcgagagcaggaagtctggacaacataattcttggtagagaggatgtgaggaatcttgtagttcccagcttccctaatgctgcccctcactctgcactaaacatgagacatctggtgccagaattgtctaactggaatcctgacattcctggtgctaccatccctggaaatgtgtcttctgtatcaagagctaatgccacttcaacgattagtcgaccagcaggctcaacatctatcgctcatcagaacctgcatcgacggcatcctagaaatttatcagaggagataggtcgtctatctggagcgcttcgtagtcagcagcacccgcgcttaaggtcagggtttctattggaacgtcagggtgatggtgtttggggtgttccgttaccaatgaggaatagcagggagggaaggcgattaatggagatacggaatgcactagaaatgattcagagaggggagaatgtcagatttgagtctattttctatggtggagtcgagattcatgatagacacagggatatgcgtcttgacatcgacaatatgtcttatgaggaactattagcactggaggaaagaataggaaatgttagcactgggctcaccgagaacgatgtgatgaagctcctgaagcaaaggaaattctcgtcgtggagattatcatctatggaatttgagccatgttgtatttgtcaggaagattacgtggaaggtgatgatcttgggacgcttcactgcgggcacgacttccatgccagctgcatcagccaatggctagtggtgaagaacctgtgtccgatctgcaaaagcaccgccctgaagacctaagacagctgcaaggctcgtcggtggcaccgcaatatcattttattgattcataataccgcaacttttttggccaaaagggttttgcattcacctaaagctcgataaagaaaaaattccaaaattccttgaaaaaaagtttcaaaactggtcatggtttcaaaaacaaagaagggttcaaaactggtattacctgtaagccgccgggcgtgtcgcggcaaataatcctgggatctgtgtctagtactcatttgactaaatattcatcatggattcgtggcaaaaaaaaaaaaaaa

SEQ ID NO: 237 - protein, 653 aa, Hordeum vulgare
MQGQRNSVEQLADVFGFDHGSGSGNPVMDQQAYWNSMLGAAESQNLQGYEMNRGDGAIPYGGEGHQDGQFLGFWGSGEASSSGNALNIGGGLRIGERRLGAEHSLSLDNVDINLNASGHDLFGQSSNANATSQASQQNAGCSRADTTAQATELRLHPYRTFGLDDEQPEPFPSLNAFEHPLGNFSLMPEDIDQRPGSSLDGRRLACKRKNIEGVHGQFSAGASTSFSHRNDNAFHSVPSSSFNPAPGPNVSSHNFLLAPSSIEEQLPNYGTTTGMSSVSYNPPSGGNNSSGNSQRSFRARTTTAQQVSPYGVWPSSGSIRHPGSYYHQAPAFQSAFDELEAAMPVVSGINLQYQHPGNVVPGIPQTAQRFAGRAAASSSRAGSLDNIILGREDVRNLVVPSFPNAAPHSALNMRHLVPELSNWNPDIPGATIPGNVSSVSRANATSTISRPAGSTSIAHQNLHRRHPRNLSEEIGRLSGALRSQQHPRLRSGFLLERQGDGVWGVPLPMRNSREGRRLMEIRNALEMIQRGENVRFESIFYGGVEIHDRHRDMRLDIDNMSYEELLALEERIGNVSTGLTENDVMKLLKQRKFSSWRLSSMEFEPCCICQEDYVEGDDLGTLHCGHDFHASCISQWLVVKNLCPICKSTALKT

SEQ ID NO: 238 - DNA, 1586 bp, Hordeum vulgare
tcggcacgagggtggcttctcggcatctatatattagaactccactggttcttctcacccctggctccctccctccctctccccatcgaggaattcaatctggtctccgtcccggcctggtccattggattggaggggcgtcagaacagggaaaggcaggcttcacaagggaaggaaggaagtctcaggtgatcctctgatcaattggcatggacgaacacatgggacggcggacggtgggcggcctcctcttcaccaaagggggctccatcctcctcttcagggaggacagctcccgccgcaaggccggcgcttgctgcccgcgcaatggctgcaacggcacccggcattcgacagacaaaggccggccaacgcccagccacagggaagcagcagcaacagcagccaaggaagcagcgccaaccacccggagatcacagcctctcaggaagaagcctccacaaggaagcagcaatccagcagagccttgtagcgaaaccgacaacaggacgggagagacggcggctccaggtgccgggcgtgacctgctggcgcgcctaaaggacagggtgaatgcgtcaaggaagcggtcgctggccagggagatgagcagctcgtcgtcgtcgtccggtgggttcagtgccagttcttctggtggtggtgccacccggtcatcagcggtgtcgaggccgacgcgtcgtgcagcgtcccggataaggaaggcagacgaaggcgaaaatgcaggaggtgctcgcagggcgcctaggagggacaccggtggtggtgttggtgccaggaggaattcagatgacccggtgatggttgggcagcgggcagcaagggagcaggcccctaccgaagggttcatctccgggttcctggcgaggtacaggggtagtctccagggagggtcgtctttgcaggacggcaccgaggactccagcgggtactggcgcttcgacgtcgaaggcagtgaagagctggagaactacttcatgctcagtgatcggcaccgggcgatgaggatggacatcgacggcatgtcctacgaggaattgctcgcgttgggtgaccggatcggcacggtgaacaccgggctttcagaggacgcgctgtacaagtgcctgaaacgaagcctgtacacgcccacagccccagagacgcacctagactgcgacagaaaatgcagcatatgccaggaggagtactctggtggtgaggaggtggggaacatggcgtgtaagcactactaccacatcacctgcatacagcactggctccggcagaagaactggtgccccatctgcaaatccgtcgccgccaagaccgtctagcgctagcaccagcagcctctgcttgtttagtgtaaacagattctcctgaaatgtctagacacaagatctgtattcttttttctattcttttctagaacgaaacatttgtttgtgccttcaagacttcttgtcttccttcagttcacaaggtccagggacaataaaaagggaacaagaaataaactcttgattagatggtggagaatttcacttgctcagtggtttatcttgtcagtgttcagtttgtgctct

SEQ ID NO: 239 - protein, 374 aa, Hordeum vulgare
MDEHMGRRTVGGLLFTKGGSILLFREDSSRRKAGACCPRNGCNGTRHSTDKGRPTPSHREAAATAAKEAAPTTRRSQPLRKKPPQGSSNPAEPCSETDNRTGETAAPGAGRDLLARLKDRVNASRKRSLAREMSSSSSSSGGFSASSSGGGATRSSAVSRPTRRAASRIRKADEGENAGGARRAPRRDTGGGVGARRNSDDPVMVGQRAAREQAPTEGFISGFLARYRGSLQGGSSLQDGTEDSSGYWRFDVEGSEELENYFMLSDRHRAMRMDIDGMSYEELLALGDRIGTVNTGLSEDALYKCLKRSLYTPTAPETHLDCDRKCSICQEEYSGGEEVGNMACKHYYHITCIQHWLRQKNWCPICKSVAAKTV

SEQ ID NO: 240 - DNA, 1564 bp, Lycopersicon esculentum
cttgtgtttctctccttcttcttcttaaaatgcttcttctctggctctgacacccccttattctctccctctcaatttcaccctttttatcttcaatatcttctctttagtgcttctctctctacaaaatcaatatcaattttctttacaaacccaaatcttgaattctccattgttgtcttctttcatctttacagtgcagagcaaccatgcctgtggtattctcagaaagctccacggtttcagaacagattagatatagaaaacccagaacgcaaaaccaacaagaaacccaagatatggatccagtttcttcttcttctcgctccactaaacccacaatttcatctctacttctagcaccattttcgcctacaagtcctatccatgaaaactcaactacccccagtgcctctacagttttttccactaaaaagaagaactttgctacatttaggggactgggttgcactgcatcaccgcaagtgtcggttcctgctgtgattaggacttcggctgactgggattccaagagaatcaagaagaaaaagcagaacagcaacaagaacaaatcccttaattctgctgttaatgttggtggaggagtatccattggctgcagcagtaactcagtccagaataataacccttcatcgtcgtcttcttcatcaggaccattatcgttatcatcgagctgtgtggcggttcctgacgtttggtgtggtcctggaattggattaactactgatgctgcttctgttgattgcgtcgtttcaagaagacccgtgtctgggaggggaagaatcgaaagtgacaaagctacgcctagagagagatctgcatgtcctatacgaagaatggtgagcccagaagacaacccttttctggatatagaaagtagcctaggtataccacgctcccaaatagagttatttgcatctaggcatcatcgacattctcgccatggttattcagaaggacttgcagagattgtgatgcttcaaaatagtcttatgggaggaagaacagatggtcttgatcgatacaggaactggagactagatgtggataacatgtcctatgaggaattgctggaacttggtgacagaatcggatatgtcaacacaggattgagagaagacgagatagctcgatgtgttagaagaaccaagcccttctttttgagtaatttatctcttatccgcacagaattggaaaggcagtgcaccatctgtcaggaggaatatgaggctgaggatgagatggggaagctggattgtggacatttctatcacattcgttgcataaagcagtggctgagtcaaaaaaatagttgcccagtttgtaaatctgcagctatgtctaatagctagacatcaaaaaacaacttctcccctcatgaaccttttggtctgttgtatagcttcttctgttatcattacaagcaagaaaattctttacagagtgtttctatcctctacttatgtgattactgaaagtgatggttctgttgtttgagtgccaatccaatgtggatggattgaaacgagtggtacacaaagta

SEQ ID NO: 241 - protein, 387 aa, Lycopersicon esculentum
MPVVFSESSTVSEQIRYRKPRTQNQQETQDMDPVSSSSRSTKPTISSLLLAPFSPTSPIHENSTTPSASTVFSTKKKNFATFRGLGCTASPQVSVPAVIRTSADWDSKRIKKKKQNSNKNKSLNSAVNVGGGVSIGCSSNSVQNNNPSSSSSSSGPLSLSSSCVAVPDVWCGPGIGLTTDAASVDCVVSRRPVSGRGRIESDKATPRERSACPIRRMVSPEDNPFLDIESSLGIPRSQIELFASRHHRHSRHGYSEGLAEIVMLQNSLMGGRTDGLDRYRNWRLDVDNMSYEELLELGDRIGYVNTGLREDEIARCVRRTKPFFLSNLSLIRTELERQCTICQEEYEAEDEMGKLDCGHFYHIRCIKQWLSQKNSCPVCKSAAMSNS

SEQ ID NO: 242 - DNA, 2609 bp, Lycopersicon esculentum
gattgtcccctctctttagtccaccaggtggtgactttagatctgttgcttcatctgctgatgttttggaggtctgcttagcggtgaagtttgagacactgctgtcactacaatactatctttgtcttttggagattgtgaatatagagttataggcctaatgcaagggcaacggagtgcaatcggatccctgccagaaactttgggttttactcatggttcaacatcgagtgatggtggtatagatcagcagatatgttggaataatttgcgaaatcctgcacaaaatcggctaccagattatatggtaccttctaatgagacaaccataccatttcttagtcatgcaaaccaagaaaggcagagtgtaattggatggaatttaggagaatccagctcctccaatacacaaaatagtgttagtcgtagtgaaaatactacaatgagtgcccgtcctgggccttctcacttctctgctgaacagcattatgggtcttccaatattctttcattgggtgatgttgaaataaatttgaataaccagttagctaacaacactttattttctcaagcttctacgtctagcactgttccaaatgaactaagtagaagtgctggacatgaggggcgtgatggcgatgaagatgatgatgatgactgcgaagtgatggagtgcaccccaacattcaagtctaatggacctggaaaagaacggatgtcaaccgccagtacttcttctgatccccttgctgggacttctgcaactaatgggtttctgagggatgaaagtgatggcagaccaggctgtacactggatggtcgacgcatggcttgtaagagaaaagcagttgaaggacatctgggacaatcttcgggaagtggaagtccagattatcttctaaacagcttatggcgttctatacctgctccaaataatctgactgcaggtgctaatagctctgcatcaacagaaagtagaagaaacatcaatttgccagcgcagataaatccaagacttgggctcactatgggtggcaccactatggaaggtccggttgcattgcctgcttcaaggagagcagaaagttaccgtagaaatttcaggcttaggatcaatggctctcatcagcaagttcctattcctggcaatacgtttcctactgtgggtaatgatagaaatgttaccatgtctgactgggacgcattgaggctgccttctaatcagtctttggattcgaggtctgtttctgctgcagataatgtaagtccccgaagccagccagttgtggggccggttccttctctgcgacgaaatgcacagaggtgggattcatctagttcaagagctggcagtccatcaagttattctgtttttcttgagaggaattctgcagcctatgaacaaccaagctcaagaagtgtgcccagaaacatttcgcagcatccaatgttcatacccgctagtgacttgagaaatttgaaccaaaatcctgtcaactggggtttagctggtggaaatatttccattgctggaaatgttgcatcttcttctcggagtggtcctagctcagtagccccttcctcttctcctggttgggtggaacaaagaaatcctcagcaatatcctcgacgactctcagaatatgttcgtagatctatgttgtcttcagctgtcagtgaacctggaagtcacaatggtaacactccgccacatttgagttctgctacctcacaggagatggggctttctggccatcccgggcatcgtccatcaagttcaaggtcagcattgttgttggagagacaactcgatggtgcaatgggagttccatattcctggaggactttggctgctgccggtgaaggaagaggcaggctagtttccgagattcgcaatgtgttggatctaatgcgcaggggagagagcttaagatttgaggacgttatgatcctcgatcagtcagggttctttgggatggtggatattcaggatcgccatcgtgatatgcgtcttgatgttgataacatgtcctatgaggaactactggcgcttgaggagcgcatagggaatgtctgcaccgggctaactgaagaaaccattttgaatcgtctgaagcaacggaaacatgttagcattagaacagaagaaaccaatgatgctgagccatgctgtatttgtcaggaagaatacaaggatggtgaggatcttgggaagctggattgtggccatgattttcatgccgactgcgttaaacaatggctcatgcagaagaatttgtgcccaatttgcaaaacaacaggactcaatacttcaggaaaacaatgatccatggaagtttgatgtaccagttggaccatggaaggttgacacaaagcgtgtctacgcgtttggtccatgagttcattctgagtgagaaagatctatgtatttttctcattaattttattctgacctctgcttagagggagttattttagagatagaagaagcactagctacaattagggtcattaggcaagagttatacattatttggttgtttggaaatttacattcttactttccaatttattgatacctttgaatattttgaaaaaaaaaaaaaaaa

SEQ ID NO: 243 - protein, 721 aa, Lycopersicon esculentum
MQGQRSAIGSLPETLGFTHGSTSSDGGIDQQICWNNLRNPAQNRLPDYMVPSNETTIPFLSHANQERQSVIGWNLGESSSSNTQNSVSRSENTTMSARPGPSHFSAEQHYGSSNILSLGDVEINLNNQLANNTLFSQASTSSTVPNELSRSAGHEGRDGDEDDDDDCEVMECTPTFKSNGPGKERMSTASTSSDPLAGTSATNGFLRDESDGRPGCTLDGRRMACKRKAVEGHLGQSSGSGSPDYLLNSLWRSIPAPNNLTAGANSSASTESRRNINLPAQINPRLGLTMGGTTMEGPVALPASRRAESYRRNFRLRINGSHQQVPIPGNTFPTVGNDRNVTMSDWDALRLPSNQSLDSRSVSAADNVSPRSQPVVGPVPSLRRNAQRWDSSSSRAGSPSSYSVFLERNSAAYEQPSSRSVPRNISQHPMFIPASDLRNLNQNPVNWGLAGGNISIAGNVASSSRSGPSSVAPSSSPGWVEQRNPQQYPRRLSEYVRRSMLSSAVSEPGSHNGNTPPHLSSATSQEMGLSGHPGHRPSSSRSALLLERQLDGAMGVPYSWRTLAAAGEGRGRLVSEIRNVLDLMRRGESLRFEDVMILDQSGFFGMVDIQDRHRDMRLDVDNMSYEELLALEERIGNVCTGLTEETILNRLKQRKHVSIRTEETNDAEPCCICQEEYKDGEDLGKLDCGHDFHADCVKQWLMQKNLCPICKTTGLNTSGKQ

SEQ ID NO: 244 - DNA, 2097 bp, Lycopersicon esculentum
gcatttgtttgttgaagatttgttcgtcttctctatatagtctttctccattttcatcagcttcgatcctataatctctctcgtgaaaaagggattttttttctttgggataaagaagaagaaaacaacgaaaacagaagagaaaaagatataaatggtgcttcgtgtaagacatggatgaatatcctgttaaaagagctgggaatgggcttgtcgccgccagaagaggtttaagggacactgctgaaaacaaagataaaaatgttcagtattgttctagacttggatgtagtggccgggtcaattatactaagagtaccagagttggaggcatggagaaaccgagaccactaaggcctactttcggttcatcaaacggaaaggaagtagttgggagttcatctgtgacatcctctggaatgactactgcaagaaggtcaggcaaggaatctcacaagaagtactcttctaacattgaagataagcgatcagataccagttccttacgtaaagagtcacaagttttaaaacagatgcagtcatcaacggagcgtcaattccaatttgattcagcaaagagagatactggatccagcaaagttgtatttacagaagttggttgctctagtggaacatcgaacagtagacctcgaaaaatatttggtcatggacctggttcttccaaccaaaagagtccaatgaattcctctatttcttcgtcgtctaaatccattagtgctgggacaaggagcagtagtagtggagagggatacaggttgagaaatctgaagtgcaattccacacctgatgtcctcccatatagttcttcatcatcagaatcaagtattagtcgaagggaaacagtaaaaaggagaaatactgaaggtgaaagcagttcatcatctaaagggaaaaaaatgagtggtgcatcgccaaatgaagggcgtgcagttcgtcctgctactggaatctccatctctgattcaaggagtagtagaagctcggatttcagtgacggtaatcgtgctgtatcagttcggacccgcaggtcaatgaatgtgagtactaggttaaggggtcctgttcaggattcattgcatactaagtcttctggcttaagccaaaatttacctgagcatggaactccaaatctagatatgcctagttcatccagtcaacttttcatggattcttcatcaagtgattatagcacatatagtttacctgcaaatgattatgatgatgacgacgaagatgaagatgaagatgatgatttacctggtgtagtaccattcacttcagcagaaatctgcattaacggtatgaaccgtgaagcattgcagagatataacatggatggagtcgctcaggtattgctggcacttgagagaatcgaacaagatgaagagttatcttatgagcgactactggcgttggagtccaatttgttcctcagtggccttaacttttatgaccagcatagagacatgagactagatattgatgacatgtcctatgaggaattattagcacttgaggagaggattggctctgttagtaccgctctgcccgaggaagaactattaaagtgcctcaggagaaacatttatcagggtatggcttcagaaacagaaacactagaagctgatgaggatggagatgacatcaagtgcagcatttgtcaggaggagtacgtgatcggagatgaaatagggaacctgggttgtgaacacgggtatcatatggagtgcataaagcagtggtttaagctcaagaactggtgccctatctgtaaggctgcagtagaatcatcgaaaccgacatcttagttgcaaaatggttagataccttaaaccccagatgtgggaaagctgttaaacagtttccctgtgtacaaattcatctggggttggtttttgtggattcctgcaattcatatttactgttctctttttcctctattctcttgaacttttttttgtctcttttcttttgcttaattgctctcttgccatatgaaccaataaacccaggccttcttctggctttgtggtggtgaatgttttcatattcatttccttcaaaaaaaaaaaaaaa

SEQ ID NO: 245 - protein, 551 aa, Lycopersicon esculentum
MDEYPVKRAGNGLVAARRGLRDTAENKDKNVQYCSRLGCSGRVNYTKSTRVGGMEKPRPLRPTFGSSNGKEVVGSSSVTSSGMTTARRSGKESHKKYSSNIEDKRSDTSSLRKESQVLKQMQSSTERQFQFDSAKRDTGSSKVVFTEVGCSSGTSNSRPRKIFGHGPGSSNQKSPMNSSISSSSKSISAGTRSSSSGEGYRLRNLKCNSTPDVLPYSSSSSESSISRRETVKRRNTEGESSSSSKGKKMSGASPNEGRAVRPATGISISDSRSSRSSDFSDGNRAVSVRTRRSMNVSTRLRGPVQDSLHTKSSGLSQNLPEHGTPNLDMPSSSSQLFMDSSSSDYSTYSLPANDYDDDDEDEDEDDDLPGVVPFTSAEICINGMNREALQRYNMDGVAQVLLALERIEQDEELSYERLLALESNLFLSGLNFYDQHRDMRLDIDDMSYEELLALEERIGSVSTALPEEELLKCLRRNIYQGMASETETLEADEDGDDIKCSICQEEYVIGDEIGNLGCEHGYHMECIKQWFKLKNWCPICKAAVESSKPTS

SEQ ID NO: 246 - DNA, 2043 bp, Glycine max
atgattaactgtcgtgatattatttttcttttcaatccacacccaccgtataacacaaacaagagagagaaagaagtgagtcattcgcatgagaaccaaattcctgattatatactttctccttgtgatatgaactcatcctatgacaattctattattaatcatgaatggcaaaatttgagtggatggagcttaggggagccaagttccagtaatacaccaaatgagatcaacaataatgagcaaaaaagagaacttggatggtcatcaaccattactgctggtgcattggctggtccaagcctagaagaaaggcgccttgaaccaaccaatgctctttcactagacaatgtcaatacaggtcctatctacatctgtagccccaattctcatttgatgtcccagaatctcaacttaaatgcaggtttagcggacagtggcagtgatgatagtcaacatctggagctccctaacttaaacaagtctagtgggtcagcaaacgagtgtataccacctaatgttggatctggttcttttctgcttccttctggaaataatgccttcctggtagaagatactgatggtaggcctagttgttctcttgatactcggcgggtctcttgtaaacgaaaggctgttgaaggaaataatggacaatcgtcagatgctgggagttctagctacagtcagcatacagatggtagtgcatggcacaccattcctactcaggataatgctggaagcagttcgagaagatctattccctcagaagaggtaaacgcaagacttggcctgggtatcggggatgaagcatctgaaaatgtttctgattcaaaaactgcaggaagctcagaaagctttcacaggaatttccgtttgaggttaaatccttcaaacccagcaaattctgttcctcccaccgcattctcaactgggagcatgattaggcattctggtgtttctccatcctctcaagtatcacaaagacttcattctgttaataattctctgaactcgaggtcggcaccaccgatagataatgtggttcctcaaagccagccacatgtaatccatgtccctgctttgcccaggaatagacaatcatttagatggagtggtggttctagctccagaaacatccattcatcaaactcaattatatccccagccagggatcaggaggatgcaagctcaagaagaatgtccagaaatatgttagaacatccagtctttcaacctgcaactgatttaagaaatttagttcaaaatccaacagttagagcttcaagttcaagtagtgtaaatttaagtattccaggaaatgttgcttcatcacggactggatcaaatccagctaccaatccctcatctgccccaacttgggtttctcctcctaatcctccacagcatccacggaggttatctgaatatgtccgtcggtccttgttttctcccagttctgatgctattggaagtccaagcaataattattcttccttgcgctctggtttttctacatctgaaccaagggcgttatcatctgggagtggggcaaacccgagatcatcttcatggttggagaggcaaggaggtagtgaatttggaattccttattcactacgtactttggctgttgcaagtgaaggaagtagtagacttgtatctgaggatgttgtgatccttgagcatcaatcatttctttctggaatagctgatgttcatgatcgacacggggatatgcgacttgatgttgataacatgtcttatgaggagttgttggctctggaagagcgcattggaaatgtgagtactggattgagtgaggaaaccctatcgaaactcttgaaacagagaaagcactcggttgaaaaagggtctgagactgatgcagaaccctgttgtgtttgtcaggaggattatggtgatgggaatgatattggaacgcttgattgtggccatgatttccatagcagctgtatcaaacagtggctaatgcaaaagaatctgtgtcccatttgtaagacaacgggcttggcaacatga

SEQ ID NO: 247 - protein, 680 aa, Glycine max
MINCRDIIFLFNPHPPYNTNKREKEVSHSHENQIPDYILSPCDMNSSYDNSIINHEWQNLSGWSLGEPSSSNTPNEINNNEQKRELGWSSTITAGALAGPSLEERRLEPTNALSLDNVNTGPIYICSPNSHLMSQNLNLNAGLADSGSDDSQHLELPNLNKSSGSANECIPPNVGSGSFLLPSGNNAFLVEDTDGRPSCSLDTRRVSCKRKAVEGNNGQSSDAGSSSYSQHTDGSAWHTIPTQDNAGSSSRRSIPSEEVNARLGLGIGDEASENVSDSKTAGSSESFHRNFRLRLNPSNPANSVPPTAFSTGSMIRHSGVSPSSQVSQRLHSVNNSLNSRSAPPIDNVVPQSQPHVIHVPALPRNRQSFRWSGGSSSRNIHSSNSIISPARDQEDASSRRMSRNMLEHPVFQPATDLRNLVQNPTVRASSSSSVNLSIPGNVASSRTGSNPATNPSSAPTWVSPPNPPQHPRRLSEYVRRSLFSPSSDAIGSPSNNYSSLRSGFSTSEPRALSSGSGANPRSSSWLERQGGSEFGIPYSLRTLAVASEGSSRLVSEDVVILEHQSFLSGIADVHDRHGDMRLDVDNMSYEELLALEERIGNVSTGLSEETLSKLLKQRKHSVEKGSETDAEPCCVCQEDYGDGNDIGTLDCGHDFHSSCIKQWLMQKNLCPICKTTGLAT

SEQ ID NO: 248 - DNA, 2073 bp, Glycine max
atgcaagggcagagaggtacagttgtttcaatgcctgaaaccttagaatttgattgtggatctgcatctggcaattctactgcggatccgcaaatttgctggaataatgtgaatcctgcagagaatcaaattcctgattatatactttctccttgtgatatgaactcatcctatgagaattctattattaatcatgaatggcaaaatttgagtggatggagcttaggggagccaagttctagtaatacaccaaatgagatcaacaataatgagcaaaaaagagaacttggatggtcatcaaccattactgctggtgcattggctggtccaagcctagaagaaaggcgccttgaaccaaccaatgctctttcactagacaatgtcaatacaggtcctatctacatctgtagccccaattctcatttgatgtcccagaatctcaacttaaatgcaggtttagcggacagtggcagtgatgatagtcaacatctggagctccctaacttaaacaagtctagtgggtcagcaaacgagtgtataccacctaatgttggatctggttcttttctgcttccttctggaaataatgccttcctggtagaagatactgatggtaggcctagttgttctcttgatactcggcgggtctcttgtaaacgaaaggctgttgaaggaaataatggacaatcgtcagatgctgggagttctagctacagtcagcatacggatggtagtgcttggcacaccattcctactcaggataatgctggaagcagttcgagaagatctattccctcagaagaggtaaacgcaagacttggcctgggtatcggggatgaagcatctgaaaatgtttctgattcaaacactgcaggatgctcagaaagctttcacaggaatttccgtttgaggttaaatccttcaaacccagcaaattctgttcctcccaccgcattctcaactgggagcatgattaggcattctggtgtttctccatcctctcaagtatcacaaaggcttcattctgttgataattctatgaactcgaggtcagcaccaccgatagataatgtggttcctcaaagccagccacatgtaatccatgtccctgctttgcccaggaatagacaatcatttagatggagtggtggttctagctccagaaacatccattcatcaaactcaattatatgcccagccagggatcaggaggatgcaagctcaagaagaatgtccagaaatatgttagaacatccagtctttcaacctgcaactgatttaagcaatttagttcaaaatccaacagttagagcttcaagttcaagtagtgtaaatttaagtattccaggaaatgttgcttcatcacagactggatcaaatccagctaccaatccctcatctgccccaacttgggtttctcctcctaatcctccacagcatccacagaggttatctgaatatgtccgtcggtccttgttttctcccagttctgatgctactggaagtccaagcaataatttttcttccttgcgctctggtttttctacatctgaaccaagggcgttatcatctgggagtggggcaaacccgagatcatcttcatggttggagaggcaaggaggtagtgaatttggaattccttattcactacgtactttggctgttgcaagtgaaggaagtagtagacttgtatctgaggatgttgtgatccttgagcatcaatcatttctttctagaatagctgatgttcatgatcgacacagggatatgcgacttgatgttgataacatgtcttatgaggagttgttggctctggaagagcgcattggaaatgtgagtactggattgagtgaggaaaccctatcgaaactcttgaaacagagaaaacactcggttgaaaaagggtctgagactgatgcagaaccctgttgtgtttgtcaggaggattatggtgatgggaatgatattggaacgcttgattgtggccatgatttccatagcagctgtatcaaacagtggctaatgcataagaatctgtgtcccatttgtaagacaacgggcttggcaacatga

SEQ ID NO: 249 - protein, 690 aa, Glycine max
MQGQRGTVVSMPETLEFDCGSASGNSTADPQICWNNVNPAENQIPDYILSPCDMNSSYENSIINHEWQNLSGWSLGEPSSSNTPNEINNNEQKRELGWSSTITAGALAGPSLEERRLEPTNALSLDNVNTGPIYICSPNSHLMSQNLNLNAGLADSGSDDSQHLELPNLNKSSGSANECIPPNVGSGSFLLPSGNNAFLVEDTDGRPSCSLDTRRVSCKRKAVEGNNGQSSDAGSSSYSQHTDGSAWHTIPTQDNAGSSSRRSIPSEEVNARLGLGIGDEASENVSDSNTAGCSESFHRNFRLRLNPSNPANSVPPTAFSTGSMIRHSGVSPSSQVSQRLHSVDNSMNSRSAPPIDNVVPQSQPHVIHVPALPRNRQSFRWSGGSSSRNIHSSNSIICPARDQEDASSRRMSRNMLEHPVFQPATDLSNLVQNPTVRASSSSSVNLSIPGNVASSQTGSNPATNPSSAPTWVSPPNPPQHPQRLSEYVRRSLFSPSSDATGSPSNNFSSLRSGFSTSEPRALSSGSGANPRSSSWLERQGGSEFGIPYSLRTLAVASEGSSRLVSEDVVILEHQSFLSRIADVHDRHRDMRLDVDNMSYEELLALEERIGNVSTGLSEETLSKLLKQRKHSVEKGSETDAEPCCVCQEDYGDGNDIGTLDCGHDFHSSCIKQWLMHKNLCPICKTTGLAT

SEQ ID NO: 250 - DNA, 1592 bp, Zinnia elegans
ccggaagatttaactatgtggactgtaggtgaacctggttcaagttcagaaccttcatcaagtttgctttctttgggtgaccgtggttcatccagctcatcattttctgacccgtttggaccgtcttctgatccatttgagttagaggcccgtcaagtcactcgtaaaagaaaagcagttgaattaactattgggcagtcttcttctggtgtcggtagttcaaccatgtttcaaggatctgaaggtggtcctcctgcagacccgactatccctcgacttgggctgagtatcggcgaacaccctgttgtggaaaacactcgcagaaatgttggtttgaggattaattctgcccgtcaacaagttgacgcgttgcccgctaataacgccaaccgggaatctgatgtttcggttctgagacttaatacgccagccgagagttcattaactcatcagggtcagcctgtcttacgggttcctgcattacgaagaaatttccaatcaacttcaagatggagagcaagccgatcagcaaatgttgctatgtcaggtgctcggaacgaggtcgattcgatttccgatcatcctctatttacaccgccaagtaatgcaacaaccccctcccaaaccgaactcaactggagttcaaacagtggtggaaatggaccgagttctgggtcttcaacaagtcatcattctcgaagactatcggcattccttcggaggtctttgttgccggttgctgatccagaggatggtgtaggacaaaatggtaatattttcccaagagttcctccggctttgagtggttcatcttcttcttctcaagacgttggagttccgccaggtcagcataatcaaccgctctcgagatcgtctttgttgcttggcagacagctcgagggagtgtttgctttcccacatcattcacggacagcgacacccaacagtgaaggaagaggcagactagtgtcagagattcgccagattcgcaatgtactggatcttatgcgcaggggtgaacctttgaggtttgaggatcttatgatcttagatcaatcggtgttctatggtgttgcggatatacacgataggcaccgagatatgaggctcgatatagataatatgtcatatgaggagctacttgcattggaagaacgcataggaaatgtgaacactggtttgaccgaagaaacaattttaaagcatatcaggcagaaacagtacgtggttggaaacgggtcagcccgatgcagaccttgctgcatatgtcaggaggaatacaaggatggagacgatctcggaacgctcgactgcacgcatgacttccattatggttgcatcaaacaatggttacaacaaaagaacttgtgcccgacttgtaagtcgaccgggtttgcgtctacttgaacagaaacggcccgtcatgaagattatatggtttcttggatcgcaagtaacttagtaaggtgttgtctttgggtaaactgttggcaaatggtattctttgcctgttacattgttagagatttatttatgttactttattgtattcttttttcatgatgaaccaaaggcacaactcatgttaagtt

SEQ ID NO: 251 - protein, 463 aa, Zinnia elegans
MWTVGEPGSSSEPSSSLLSLGDRGSSSSSFSDPFGPSSDPFELEARQVTRKRKAVELTIGQSSSGVGSSTMFQGSEGGPPADPTIPRLGLSIGEHPVVENTRRNVGLRINSARQQVDALPANNANRESDVSVLRLNTPAESSLTHQGQPVLRVPALRRNFQSTSRWRASRSANVAMSGARNEVDSISDHPLFTPPSNATTPSQTELNWSSNSGGNGPSSGSSTSHHSRRLSAFLRRSLLPVADPEDGVGQNGNIFPRVPPALSGSSSSSQDVGVPPGQHNQPLSRSSLLLGRQLEGVFAFPHHSRTATPNSEGRGRLVSEIRQIRNVLDLMRRGEPLRFEDLMILDQSVFYGVADIHDRHRDMRLDIDNMSYEELLALEERIGNVNTGLTEETILKHIRQKQYVVGNGSARCRPCCICQEEYKDGDDLGTLDCTHDFHYGCIKQWLQQKNLCPTCKSTGFAST

SEQ ID NO: 252 - DNA, 2103 bp, Lotus japonicus
tattgctgcacacaaccgcttgctttatttcattgtctccttctttctttctttctttctcagaacaagaacaaccctcttcttctgtttctgcttctctctgtaactttctctctcatcatcttgcgtgttcaagatcgttactcaaccgtcatcggattctcaccgattcacaaggcaggtttctttgtgctgttgatctgttgtacatgattacatctgcatgcactgattgtgattatttgcacatctgactcaattagtctattttgactcccggggattgcaagtaacagttatggggcatagacatttgtataacacaaccccattgtttgagggtgagcctgaccagaattggaatcatatgcatactgatcaacattatgtgaaccttggtaggactagcactgcagagaatggttcctatttttatcctgtggaaaatgtgtccatagatagcacttctttcccctctcattggaaccctgcaacaaggtcaaatggatatgcatcttcaagtctcaacattgaagtacctcctcatcaatcagatacatcaggcgcttcaaatgatcattttatacattcgtctagtgctggagctttctttgcagtatctaataattgtgtgcctcagccgcctgcggccaattatgacagaccaccatttcaggttgatggtggttttattgatcttacgatgggaagtggacgagggcctcacaagcgaaagagccctggaattccatcagtctatgagagaggcggttcaagcagatatttcaatgctgggagttcaactgatgttcctatatcttcagaatcgcggcccgagaagccaaatatagattctcaatatatgccctgggatcatgttcctatgacatccacagtcagaggtgcaggccactcaataaagggtgagagttctttgaggaatgtgaggagccgttctgcacttgatttggaatccaacctttctaggacccatttaccaagtaatcattcgcacaactcctactctactatcccaccagttgaccattctagcatgatggatctttcaggtcagatttctacctctttgacaggggattggagccaaatgaacatatctcctgctaatggaagggtgttattaccagatgccggtgcttatggtcttgagtcaagtcacttccttgctggaagtggtgctactgctagtaatgcttctgttgatgttgggagcttccatcatgaatttggtacaagcagaaatcctactggtcctcaaagttttcataatctgactcagactgctaggggaatccgaagtaactattctcagagatcagcccctacttttagggcttcttcaagcacgcacttgggacatgtgacaccattggatgatggattgcccatggtagctgaaagttactcttctagacatcaaaggccattatccagcattggatggcggaacagtgatcgaaatgggagggcaagaatttctagtgaaagatatcgatcattggctaatgaggccggtctccatggtcgaatttcccctgaggttttcatgattgtcgatcgcgcatcaatgtatggttcaaggaatatgcttgaccagcacagagacatgaggatggacatagataacatgagctatgaggaactacttgcacttggtgagaggattggccatgttaacacgggattatccgaggattcgttttcccagtgtatgacagaaacaatatattgttcatctgagcaaggtcaagacgaaggaagctgtgtaatctgtctggaagaatacaagaacatggacgatgttgggacacttaaaacttgtggacatgattaccatgtgaactgcattaagaagtggttatctatgaagaaactatgtcctatctgcaaagcttctgttatgcccgaggataagatgaacaaataaataaattatactgtagtatgattaatctcactctgtatatatatttggacatccttcaaagtggaggaaacagacttgcttttagagaagttgaacaggactgctactgtgttcatgtatttattttagtctttgaattcaattaaaaaaaaaaa

SEQ ID NO: 253 - protein, 549 aa, Lotus japonicus
MGHRHLYNTTPLFEGEPDQNWNHMHTDQHYVNLGRTSTAENGSYFYPVENVSIDSTSFPSHWNPATRSNGYASSSLNIEVPPHQSDTSGASNDHFIHSSSAGAFFAVSNNCVPQPPAANYDRPPFQVDGGFIDLTMGSGRGPHKRKSPGIPSVYERGGSSRYFNAGSSTDVPISSESRPEKPNIDSQYMPWDHVPMTSTVRGAGHSIKGESSLRNVRSRSALDLESNLSRTHLPSNHSHNSYSTIPPVDHSSMMDLSGQISTSLTGDWSQMNISPANGRVLLPDAGAYGLESSHFLAGSGATASNASVDVGSFHHEFGTSRNPTGPQSFHNLTQTARGIRSNYSQRSAPTFRASSSTHLGHVTPLDDGLPMVAESYSSRHQRPLSSIGWRNSDRNGRARISSERYRSLANEAGLHGRISPEVFMIVDRASMYGSRNMLDQHRDMRMDIDNMSYEELLALGERIGHVNTGLSEDSFSQCMTETIYCSSEQGQDEGSCVICLEEYKNMDDVGTLKTCGHDYHVNCIKKWLSMKKLCPICKASVMPEDKMNK

SEQ ID NO: 254 - DNA, 1494 bp, Arabidopsis thaliana
atggataggtggtccagtaaaagagccatggaggcgagacctgactctaagaagaagggtggtgttgtttttagagatagatttaacagcaatagttgcaaggttcctatttgtagtgatgagaaaaaatcaatgaactttactaggtttgttggctcttcagataagaaagagaaatcagtgttgtctacataccgctcttcgccaaacgggaaggaagtaattggaacttcctctaagatttgtatctctagctcctcttctgtgaaaagtggtgagaagcaaccgttttctcagatagccattgattcatcagagagcagcagaggtagtgaagacgaggtagagtcagaaatcttgcaagttcctcttggaagagataaaagaagaatgaacaataaacttatttatggaaaagttataacacctgaagcggaatgctcaaagttgccatcaagctcaagaatcaagagaggttttaggcagagatttgggttgagcaagcaagagtttcatcctggtccatctggccagtcaacatctgctaaccggggatgcagcccgttgttgtcaggtgtcattccaagtggttttggattggacaaaagattaagtcggaaggcagatacaatcagtaagacaaaagtttacggagaaagcagttctagctcctcagctagggggaagaatgtaacagaacctccaccagttgaagtgagacgtcgtagttttaatccgagaggttctgtttctgatagtagacgggctagacactgcattttggatgatgacaacgatgttgcttcagttgggagtcagagattggcaaatagaaataatagtcgcattagagggagtggtagagacggtttatcctctgtcacggcagcagagatgtctcagactgaaacatcaaacaatctcaattctcctgtctctttggagctgttctctggttttccagaatttggcctctctggttccttattgagtcatgacagttttcgcagttataatttagatgggatctccgagattctgccagaacttgataggatcgaacaagatatcgaacttaattatgaggatctgcttatcatggaaacaggtttacttctcggtggactaagcttccatgaccaacaccgagacatgaggctagacatcgataacatgtcatatgaggaactattagctctagaagagaggattggtacagtaagcactgctttgacagaagaagcaatatcaaagtgcttgaaaacaagtatctatcagatgaaacctttgagttatgggtctatcaccaaaagtcctagtgataacaaggaagatgccaaatgcagcatctgccaggaagaatatacgattggagatgaagttgggaggctacactgtgagcacacataccatgtgaagtgtgtgcaagagtggttgcggataaagagttggtgcccaatctgcaaagccacagccgaaacctcctctaaataa

SEQ ID NO: 255 - protein, 497 aa, Arabidopsis thaliana
MDRWSSKRAMEARPDSKKKGGVVFRDRFNSNSCKVPICSDEKKSMNFTRFVGSSDKKEKSVLSTYRSSPNGKEVIGTSSKICISSSSSVKSGEKQPFSQIAIDSSESSRGSEDEVESEILQVPLGRDKRRMNNKLIYGKVITPEAECSKLPSSSRIKRGFRQRFGLSKQEFHPGPSGQSTSANRGCSPLLSGVIPSGFGLDKRLSRKADTISKTKVYGESSSSSSARGKNVTEPPPVEVRRRSFNPRGSVSDSRRARHCILDDDNDVASVGSQRLANRNNSRIRGSGRDGLSSVTAAEMSQTETSNNLNSPVSLELFSGFPEFGLSGSLLSHDSFRSYNLDGISEILPELDRIEQDIELNYEDLLIMETGLLLGGLSFHDQHRDMRLDIDNMSYEELLALEERIGTVSTALTEEAISKCLKTSIYQMKPLSYGSITKSPSDNKEDAKCSICQEEYTIGDEVGRLHCEHTYHVKCVQEWLRIKSWCPICKATAETSSK

SEQ ID NO: 256 - protein, 1485 aa, Arabidopsis thaliana
ATGGGACAAAGAAATAGGAATGTTGATTTAGAAATGGAGCAGCAGCAATCTCAAGCTTCTCTCCAAGCAGAGCCTTGCATCCTTTTAGGCAGCTTTCCGCAACAACCGGATAATAATAATATGCCTGCTATGGTTGCACACGTTCCTAATTTAGAACCTCATTCTCTTCAAGACCCAACTTATGACAACTCGGCCATGTTCTACGGGCTTCCTCAGTATCATCATCATCCTCACCAGCGTGTTCCAACGAATTTCTATGTTCCCTATGTGGCATTTCAGGCTCCTCCGGGTCAGTTACCATCTTCAAGCAGTCACGGTGTAGTTGGTGTAAGTCCTGATCATGAATACGAAAGAAATGCTCATTTTATGGATCACACAAGAGGGACATACAAGCGAAAGAACGCTGAAGGAATACCCGGACAACCTCAATATTTAAGTACCTTAGCAGCTCCATTTAACACACCGGAGACAATAGCCCCTTTTGGAGGCGCTAGGAACAGACCAGGAGCTGTTACAGTGAACACTGTTCTTCCTTCTCATGCTCCAAACAACTTCATTCAAGGAAACTATGCAGGTCATCATCCTTTTCCACCTCCTGGCTCAATGTGGTATGATCAACACCACGGCAGATCTGATGGCTCACCTTCGTTCTGGCCCACACCTTACATGCACGGTAGTAACATTTTCGCTGGTTCCATAGAGTCTAGTAGCAGAAACCCTACATCATTTATGTATCCTTCTCAGTTAAACCCGAGGGACCACTATTATAGTCATCATCACCACCCGGCACCTCCTCCTGTACAAGGCATGAGAGGCCAGAATGCCACATTATATCCCCACACAGCTTCTTCTGCTTCATACAGAGTTCCTCCAGGGAGTTTTACTCCTCAGAACACAATGAATAGTGGTCCCTTGGGGTCAGAGATGGGCTCGAGTCACATGGGTCCGGTTCAACCAACCGGGTTTCGGATATACCAGCATCATCAGCGAGATGATTCTGTACCTGTAGCAACTCTTAGACAACACCGTGGAGGAGTTCCTCGGCTTAGAGTGATGCCTGATGATGAAGTTGCGCTTTTGGAGTTTGGAGACTTCCTTGGTGGTTCTGGAAATAATCACATTGATCATCATCGAGATATGCGATTGGACATCGAGGAAATGTCTTACGAGGAGCTTCTTGCTTTGAGTGAGCGAATTGGAACAGTAAACACTGGGTTGCCGGAGGAAGATGTTAAGAATCATTTGAAAACAAGAACATGTTCTGGAATCAACTTTGAAAAAGAGTCGTCGTCCCCACGAACTAAAGATTTAGAAACCGAACCGTGCACTATATGTCAGGAAAGCTTCAAGAACGAAGAAAAGATTGCGACTTTGGATTGCGGGCACGAGTATCATGCAGAGTGCTTGGAGAAATGGCTGATTGTGAAGAACGTTTGCCCAATCTGTAAATCAGAGGCACTGGTCATGGAGAAGAGAAAGGTATAG

SEQ ID NO: 257 - protein, 494 aa, Arabidopsis thaliana
MGQRNRNVDLEMEQQQSQASLQAEPCILLGSFPQQPDNNNMPAMVAHVPNLEPHSLQDPTYDNSAMFYGLPQYHHHPHQRVPTNFYVPYVAFQAPPGQLPSSSSHGVVGVSPDHEYERNAHFMDHTRGTYKRKNAEGIPGQPQYLSTLAAPFNTPETIAPFGGARNRPGAVTVNTVLPSHAPNNFIQGNYAGHHPFPPPGSMWYDQHHGRSDGSPSFWPTPYMHGSNIFAGSIESSSRNPTSFMYPSQLNPRDHYYSHHHHPAPPPVQGMRGQNATLYPHTASSASYRVPPGSFTPQNTMNSGPLGSEMGSSHMGPVQPTGFRIYQHHQRDDSVPVATLRQHRGGVPRLRVMPDDEVALLEFGDFLGGSGNNHIDHHRDMRLDIEEMSYEELLALSERIGTVNTGLPEEDVKNHLKTRTCSGINFEKESSSPRTKDLETEPCTICQESFKNEEKIATLDCGHEYHAECLEKWLIVKNVCPICKSEALVMEKRKV

SEQ ID NO: 258 - DNA, 1641 bp, Arabidopsis thaliana
atggggcacagacattttcttggttcatcccagttttttgatgatgaacatgatcaaggctggaatcatacacacccagaacatccatattcgagtcaagcaacatctgggaccagtgagaacagatcacatgtttatccagcagaaaacatgttgaatgaaggaatgccagtgtcttctcattggaactcttctccaggaccaaatgcttatactgactcaggtcatagtgtggagagaccacactacaatccgggggtttcggggccgtcccatgatccttccgtgaattcaacagttccaactttctctgctccacatgagaattatgtgacatttgcatcttcttcaagctacaacagccagacatggtcaaatgctagttatgttgatcatcaatctatggaaagtgtgagaggagcacaaaagagaaaacgaccatgtccttcttccatctatgaaatgggtagttcaagccaatatcacggtgacagaactcctgcagacactcatttcccctcggaattgcacttgggaaaatcaataacgcatgatcatgaccctcattacatgccatggcttatgaacccaacttacagaagtaataatctctcgatcaggggagagagctcttcaaggaatgtccggagtcgtcctacacttgattcagagaccagcttaggtagaaataatttgccaagaagcttgagccttgattctcattctacacaccaccacagtgttgatcattatggctcaggtcaatttcctggtcagacatctcacggaaataaagactggaactgtgctagattgtccccagttcttagagatataaatggctttagtccagagacaaataatttccttcctgcaagaagtgttgtcaacagcttatctgttaatacttccggctatcatcaccatgagcttaccggaaacagaaaccctacagtttcccacggggttcctggaacttcaacactatctacaagcagcagccgcttctctcataggtcaacatccacctatagatcttcttcacacggttcgcgatcgggacatgtagcatcttcttctggagacaggtctcatttggtcactgagacttatccgtctaggcatttaaggccaccaccacacatttcatggcgtagcggtgatcggccagggagacgcagaagttcctatgagaggtttcagcctcctttcgatgaagttgctctccacgaacggttttcatctgaggaattcatggttgaagatcgccaaccacaatactacggatccagaaacatgcttgatcaccacagagacatgaggcttgacatcgataacatgagctatgaggaactccttgatcttggagaaaggattgggagtgtcaacactggtctatccgacagcgcaatctccagttgcttgttagcaacaatgtattatccatcatatcaaacagaggagcaaagaaaatgtgcaatctgcctggaggagtacaaggaaaaagaagagttaggggaagttaaggggtgtggtcatgactaccatgggaggtgcatcaagaaatggttgtctatgaagaactcttgccctatttgcaaatcccctgctttacctgatgcttctaagaactcatcataa

SEQ ID NO: 259 - protein, 546 aa, Arabidopsis thaliana
MGHRHFLGSSQFFDDEHDQGWNHTHPEHPYSSQATSGTSENRSHVYPAENMLNEGMPVSSHWNSSPGPNAYTDSGHSVERPHYNPGVSGPSHDPSVNSTVPTFSAPHENYVTFASSSSYNSQTWSNASYVDHQSMESVRGAQKRKRPCPSSIYEMGSSSQYHGDRTPADTHFPSELHLGKSITHDHDPHYMPWLMNPTYRSNNLSIRGESSSRNVRSRPTLDSETSLGRNNLPRSLSLDSHSTHHHSVDHYGSGQFPGQTSHGNKDWNCARLSPVLRDINGFSPETNNFLPARSVVNSLSVNTSGYHHHELTGNRNPTVSHGVPGTSTLSTSSSRFSHRSTSTYRSSSHGSRSGHVASSSGDRSHLVTETYPSRHLRPPPHISWRSGDRPGRRRSSYERFQPPFDEVALHERFSSEEFMVEDRQPQYYGSRNMLDHHRDMRLDIDNMSYEELLDLGERIGSVNTGLSDSAISSCLLATMYYPSYQTEEQRKCAICLEEYKEKEELGEVKGCGHDYHGRCIKKWLSMKNSCPICKSPALPDASKNSS

SEQ ID NO: 260 - DNA, 1563 bp, Arabidopsis thaliana
atggatggatttaagggtaaaagaacatctagaccgattatgccacggaaagcaagtggtcttgtgttacatgagaatatgaagaagaaagatgataagagtgttgtccctatctgcagtagaattggttgcagttccagggttagttccactaagggagatttgattgatcataaagcaaaagctactgtgtcttcgtttcgatctcctttgagtggaaaggaaaccgttggtagttcatctcgaagtatgagtggatttggtggtacaaaaaaggcttccaaggttattggtaggagacaactctcttctcttttggacatggattcttcagagagcagcagtgttaatgaagactcacccacaagtgagcgttcccttcctcgtggaaagacaaaagaaagcactattagtgttcattctgaaagtagtgtctctggagaagttgtgacagaggcaggaagctcgagtagaggaactggtagaagcattcatcagagacctgatttggtctcccgagatgctcgtgtgagtaatagtgagcaaaatgcaagagctagtgtgaacaagaatggattaagagacttgaggaacaaatctggttctgatgttcttccatctaattcaactccgacaagaaaaagtaacatctttagaaagaaaacctctgatggtgagagcagctcttcgagtagagggaataagacggaaggatcagtggttgggggaaagaatattagttcccctcaggggaatggcatcaccatgtctgaacctaggaggaacagaaacttaccaagtgttagggacaacagtgttgtttcaagtagtactaggagatcaactggttattatggtagaacaggacgtgctggagcggttgcaacactacaagcacctcggcctccaacaagagctgatctcaatccttctagatcggcagaagcttcgcgtagtcctttaaatagttacagtaggccaatcagtagtaatggcaggttacgtagcctgatgatgcctggtagcccctcagaagccggcctttctcgctctttgatgaaccgtgatactttcagacggtataacatgaatggagttgcagaggtattgttggccctggaaaggattgagcaagacgaagagcttacatacgagcaattggctgttttagagaccaatctgttcttaaatggtatgagcagcttccacgatcagcatagagatatgaggcttgacattgacaacatgtcgtatgaggaactgttagcattagaggagaaaatgggtacagtgagcactgctctaagcgaagaagcgcttctgaaaagcctcaagtcaagtatttaccgtccaaacgatgaatccgacgacatttgcctgaacaaagatgatgatgtcaagtgcagcatttgccaggaagagtatgttgatggagatgaagtagggactttgccttgccaacataaataccacgtgagctgcgcgcaacaatggctacggatgaagaattggtgtcctatatgtaaaacctctgcagaatctcagccacatccattttcatga

SEQ ID NO: 261 - protein, 520 aa, Arabidopsis thaliana
MDGFKGKRTSRPIMPRKASGLVLHENMKKKDDKSVVPICSRIGCSSRVSSTKGDLIDHKAKATVSSFRSPLSGKETVGSSSRSMSGFGGTKKASKVIGRRQLSSLLDMDSSESSSVNEDSPTSERSLPRGKTKESTISVHSESSVSGEVVTEAGSSSRGTGRSIHQRPDLVSRDARVSNSEQNARASVNKNGLRDLRNKSGSDVLPSNSTPTRKSNIFRKKTSDGESSSSSRGNKTEGSVVGGKNISSPQGNGITMSEPRRNRNLPSVRDNSVVSSSTRRSTGYYGRTGRAGAVATLQAPRPPTRADLNPSRSAEASRSPLNSYSRPISSNGRLRSLMMPGSPSEAGLSRSLMNRDTFRRYNMNGVAEVLLALERIEQDEELTYEQLAVLETNLFLNGMSSFHDQHRDMRLDIDNMSYEELLALEEKMGTVSTALSEEALLKSLKSSIYRPNDESDDICLNKDDDVKCSICQEEYVDGDEVGTLPCQHKYHVSCAQQWLRMKNWCPICKTSAESQPHPFS

SEQ ID NO: 262 - DNA, 2076 bp, Arabidopsis thaliana
atgcagggggagagggccagtcttggctatttatcagaggccttgaactttgagcatggttcttcttcaagtaatggtgtgatagatcattgggagaatattcacagtcttggtgataatgacttgcaggattacatgattgcaaattctgaatcaaatacttcgcttgcaaactcagtttatcacgagcaacagggtttacgcagatttagccttggtgaggctagctctagtggcacgaaggatgaagcttccagtcacaatgagcaacgaatggaaacaagatgctttgacggacgaggaaatgaaataattgatttagacccagtgtttgcgcagccatcaggcacaaatcaacctgttcagaatgtcaatctgaatgcagagtatatagaaattcacgaggatattaatccatatagaggtcggtctggcttcatagaagctaatggaccagggaccagggtctcacaacctggcagatcttttgaagagaacggtgttggaacaggttcttctgtagagggacgtcgtgcatcctgcaaaagaaaagctcttgaaggcagtattagtcaatcttcttcaggaggttatcatgatttccagcgtggagaaagcagttcgtggaccccaggttctacggtttttaggccaggaaatggtttaaacatatctggctcccttgacaatggaccaagaggaatggtctccggtactgtaccaaattttcctgtttctgcaccaaattttcctgtttctgccattgcagagagctccagtagaaatatatgcgtcaggagtaatccctcagatcatcaagaaactgtaaacccatctacctttgctgcgggaactgttgtcaggcggcctgtccctccatcccagttgaacttgtcaagacacttaccagcagatcagcattcattggacttgagacctggacagtcttttgtcgtttctcgtaacccaaattctactcctgtgagcataccacctggttcaaggactatgctaccaccatttcggtggactgggagctcactagtgggtggaacatcgaactctactgcgcccgttgagagaaatcttcatctagatgaaaccaggtcaagaagcatacccgggaatactcttgagattcccatgtttgcagctcctgaggtaggaaattttgcccgtagtcagagtagcagaaatgtaacaaatggaaacctgaatagtgcatcatcagtgtccaggacaggctcaacaacaagtgttccaccaccaccaccaccatcttctaatctagcgtggacttcttaccagaattcaccacattatcaaagaagaaggactgaaaggtctgaacttgcacgtaggtccttgctttcttcccttgcagcagatgctacaaaccagagatctggtgatcatccaacacttcgttcgttggcccctcctgcctcttcggatgggcttgtgcttcagcctggtggtgataatagtcagatgcataatcgggcttactcgagagcaggtccgttgtttgataggcaaggggatagtgtggttggtattcctcatcctttgcgggccttggcagctgcaagcagaggaagaagcagacttatggtgtcccagatgcagaatgtcttggatgtcatgcgtagggatgctaataataacaacttgcggcttgaggacgttatgcttctaaatcactcagtactatttgatggggctactggtcatgaccggtatagagacatgcgacttgatgtggacaacatgtcatatgaggaattgttggcactagaagagcggattggagatgtttgtaccggtgtaaacgaggaaaccatatcaaaccggttaaagcaacgaaaatacaaaagcaacacaaaatctccacaagatgcagagccatgctgtgtttgtcaggaggaatacaccgaaggagaagacatggggacactagaatgtgggcatgaattccatagccaatgcattaaagaatggctgaaacagaagaatctttgcccaatctgcaagactacaggcttgaacaccgcgaagaagcggaggatagcatga

SEQ ID NO: 263 - protein, 691 aa, Arabidopsis thaliana
MQGERASLGYLSEALNFEHGSSSSNGVIDHWENIHSLGDNDLQDYMIANSESNTSLANSVYHEQQGLRRFSLGEASSSGTKDEASSHNEQRMETRCFDGRGNEIIDLDPVFAQPSGTNQPVQNVNLNAEYIEIHEDINPYRGRSGFIEANGPGTRVSQPGRSFEENGVGTGSSVEGRRASCKRKALEGSISQSSSGGYHDFQRGESSSWTPGSTVFRPGNGLNISGSLDNGPRGMVSGTVPNFPVSAPNFPVSAIAESSSRNICVRSNPSDHQETVNPSTFAAGTVVRRPVPPSQLNLSRHLPADQHSLDLRPGQSFVVSRNPNSTPVSIPPGSRTMLPPFRWTGSSLVGGTSNSTAPVERNLHLDETRSRSIPGNTLEIPMFAAPEVGNFARSQSSRNVTNGNLNSASSVSRTGSTTSVPPPPPPSSNLAWTSYQNSPHYQRRRTERSELARRSLLSSLAADATNQRSGDHPTLRSLAPPASSDGLVLQPGGDNSQMHNRAYSRAGPLFDRQGDSVVGIPHPLRALAAASRGRSRLMVSQMQNVLDVMRRDANNNNLRLEDVMLLNHSVLFDGATGHDRYRDMRLDVDNMSYEELLALEERIGDVCTGVNEETISNRLKQRKYKSNTKSPQDAEPCCVCQEEYTEGEDMGTLECGHEFHSQCIKEWLKQKNLCPICKTTGLNTAKKRRIA

SEQ ID NO: 264 - DNA, 2001 bp, Arabidopsis thaliana
atgcaaggtccacgaagcactggtgattcatcgactggaataaattatgcagatggagaacccatctgtagcaccaattcagagactacttccaataacatcctgaatccagtggatgttcagtttccaaacaatactacaggttcaggacgaccaacttacgcaagctctagctcgcatgttgttcaaaatcataactggtggagttttggtgaatccagctctagattggggccttctgatcatttaaattccaatggttcaaagactgatcgacagcttctctcagatggctatggatttgaggaagggcaatcaggtatgttgttacctggagagtcctttttgcgtgggtcaagctctagtcatatgttaagtcatgtaaatctgggcaaggacatggacattggtagtggtctgcagacttctggggtcgttatccgccataataactgcgagacttcattgggaagctcaagtcaaaccgcagaggagagaagcagtggtccaggttcttcgttgggtggtctaggttcatcctgcaaaagaaaggctcttgaaggagctcctagccattctttccctggtgaaagtcatggttgcttttttcaaactgagaatggtgcttggaatgagggtcttgctcaatatgatgcttcaagtagcttaagtttgtctatgccctcacaaaattctccaaatgttaataatcagtctggtctaccagaaccaagatttggattgggtggtgggagagcagttacagcaagtgcttttccttctacaagaagcacggaaaccatctctagacctggcaggcggttaaatcctgggcagccaccagagtcagttgcattcagcttcacacagtccggtagttctgtgcgtcagcaacagcagttaccagcaacttctccttttgttgaccctctggatgcaagagcaataccagttacaggtagctcaagcagtggtgatggtcagccaagtatgatccaccttcctgcattgacaagaaatatacaccaatttgcttggagtgcttcgtctagttcgagagcaaacagtatgcctgaagagggattgtcaccatgggacgcgccaagaataaactcagagcagccagtctttactacacctgcaaatgaaacgagaaatccagtgcaggatcagttttgttggagtttcactcgtggaaaccctagtacatctggagattctccctttgttcctcgagcaggatcgagttcagggatccatggtttgcagccgaatcccacttgggttactccccataatcaatcaagaatatcagaagttgctccgtggtctttatttcctagtatcgaatctgaatctgctactcatggtgcttctcttccattactacccacagggccttctgtttcctcgaatgaagctgcagcgccgtctggatctagtagtcgtagtcatcgctctcgacaaagaagatcgggattattactggaaaggcaaaatgatcatctccatttgcgtcacttaggaagaagcttagctgctgataatgatggaaggaaccggctgatttccgagatacggcaggtgttgagtgccatgcgaagaggggagaatttacggtttgaggattatatggtattcgatccactgatctaccaaggtatggccgagatgcatgataggcatcgggatatgcgtcttgatgttgataacatgtcatatgaggagctattggcacttggggaacgcataggagatgtgagcactggtctaagcgaagaggtgatcctgaaagtaatgaaacagcacaaacatacatcatccgctgctggctctcaccaggacatggagccttgctgtgtctgtcaggaagagtatgcagaaggagatgatcttggaacactgggatgtggtcatgaatttcacactgcctgcgtcaagcaatggctgatgctcaagaatctctgcccaatttgtaagactgtggctttatcgacataa

SEQ ID NO: 265 - protein, 666 aa, Arabidopsis thaliana
MQGPRSTGDSSTGINYADGEPICSTNSETTSNNILNPVDVQFPNNTTGSGRPTYASSSSHVVQNHNWWSFGESSSRLGPSDHLNSNGSKTDRQLLSDGYGFEEGQSGMLLPGESFLRGSSSSHMLSHVNLGKDMDIGSGLQTSGVVIRHNNCETSLGSSSQTAEERSSGPGSSLGGLGSSCKRKALEGAPSHSFPGESHGCFFQTENGAWNEGLAQYDASSSLSLSMPSQNSPNVNNQSGLPEPRFGLGGGRAVTASAFPSTRSTETISRPGRRLNPGQPPESVAFSFTQSGSSVRQQQQLPATSPFVDPLDARAIPVTGSSSSGDGQPSMIHLPALTRNIHQFAWSASSSSRANSMPEEGLSPWDAPRINSEQPVFTTPANETRNPVQDQFCWSFTRGNPSTSGDSPFVPRAGSSSGIHGLQPNPTWVTPHNQSRISEVAPWSLFPSIESESATHGASLPLLPTGPSVSSNEAAAPSGSSSRSHRSRQRRSGLLLERQNDHLHLRHLGRSLAADNDGRNRLISEIRQVLSAMRRGENLRFEDYMVFDPLIYQGMAEMHDRHRDMRLDVDNMSYEELLALGERIGDVSTGLSEEVILKVMKQHKHTSSAAGSHQDMEPCCVCQEEYAEGDDLGTLGCGHEFHTACVKQWLMLKNLCPICKTVALST

SEQ ID NO: 266 - DNA, 1938 bp, Arabidopsis thaliana
atgcagggagagagggctagtcttggttctttatcaaaggctttgaactttgagcgcggttctacgtctagtaacgctgtggtagatcagcaaattcgttgggagaatcttcacaattatggtgataatgatttgcaggattacatgagttcagctgctgatacaaatcctacttttgcaaactcagtttatcatgagaaacggggcttgcagaggtttaacattggtgaggctagctctagtgggacgaagaacgaaggggcaagtctcactgaacaatggaagggaattggaaggtttgaggaacagaggaatgataagcttgagttgagccctttgtttgtgcaaccatctaatggaagccgcgtggttcgtgatgtcaatctaaatgcagaatacaatgagcatcttgaggatatgaatccggttacagttcatcctggtcattttgaggttaatggacttaggtctgagtttttactagataacagtgttagagctggttcctctgttgatggacgtcgtgcatcctgtaaaagaaaagctcttgatgcaagcggtggtcagtcctcttcaactggaggtttccgtgagttccagcgtggagtatccagttcttggatctcaggtcctacgtattacagcccagcaatgacagcaaatgatttaaacatatctcttgatcatggtcgaaggggtttggtatctagcgctgttccaaatctatctcctcctaccatcacagagagctctagtagaaattaccctgtctgggttaatcccacatatcaacaagaaaccgtaagcaattttgctccatccttgaactcaccagggcttatacctgcagatcaccagcagatcagcatgagatatggacatgcgttaggcaattttgcatctcagaacccaaatgctcctgctactcatatgccccctgtttcaagaaatacatttcaatggaacacaagccccgtggcagcggttatatcatctagttctgctactcctgttgacagaaatgttattcatcgaaatgcaaccagacaaagaagtaatactctagagattcccttgtttgtcccagctcctgaactgagaaatgtggcccatggtcatattagcagaaatgcaagtggtgctagacatgttgcatcgtcttcatccaggacaagtgttcagccatcaccgtctagtccagcattgactccttaccagaataactcactacataatcaaagaagattatctgaaaactttcgtaggtcattgctttcttcccttgttacacagcagagggctgctcgttcattggcccatcctgcctctccaaatgagcacgtgcttcaatctggtggtgataacacctctcaggtgcataatcgagcttcctcgagagcaggtccaagacaagggcaagatgcaactggcatttctcattctttgcgaggcttggcatccacaagtcgaggaagaaccagaatgggggcatccgagatccgtaacatcttggagcacatgcgtagagcagggaacttgcgtttggaggatgttatgcttctcaatcagtccataatgctaggtgcggctgatattcatgaccgatatagagacatgcgacttgatgttgacaacatgacatatgaggagctgttgtctctagaagaacggattggagatgtttgtaccggtttgaacgaggaaaccatatcaaaccgattgaagcagcagaagtacaaaagtagtactagatcttcacaagaagtagaaccatgctgtgtttgtcaggaggaatataaggaagaagaagaaataggaaggctggaatgtggacacgactttcatagtcaatgcatcaaagaatggctgaagcagaagaatctttgcccgatttgcaaaacaacaggattaaacactgcaaataagccacaaagataa

SEQ ID NO: 267 - protein, 645 aa, Arabidopsis thaliana
MQGERASLGSLSKALNFERGSTSSNAVVDQQIRWENLHNYGDNDLQDYMSSAADTNPTFANSVYHEKRGLQRFNIGEASSSGTKNEGASLTEQWKGIGRFEEQRNDKLELSPLFVQPSNGSRVVRDVNLNAEYNEHLEDMNPVTVHPGHFEVNGLRSEFLLDNSVRAGSSVDGRRASCKRKALDASGGQSSSTGGFREFQRGVSSSWISGPTYYSPAMTANDLNISLDHGRRGLVSSAVPNLSPPTITESSSRNYPVWVNPTYQQETVSNFAPSLNSPGLIPADHQQISMRYGHALGNFASQNPNAPATHMPPVSRNTFQWNTSPVAAVISSSSATPVDRNVIHRNATRQRSNTLEIPLFVPAPELRNVAHGHISRNASGARHVASSSSRTSVQPSPSSPALTPYQNNSLHNQRRLSENFRRSLLSSLVTQQRAARSLAHPASPNEHVLQSGGDNTSQVHNRASSRAGPRQGQDATGISHSLRGLASTSRGRTRMGASEIRNILEHMRRAGNLRLEDVMLLNQSIMLGAADIHDRYRDMRLDVDNMTYEELLSLEERIGDVCTGLNEETISNRLKQQKYKSSTRSSQEVEPCCVCQEEYKEEEEIGRLECGHDFHSQCIKEWLKQKNLCPICKTTGLNTANKPQR

SEQ ID NO: 268 - DNA, 2115 bp, Arabidopsis thaliana
atgaatccaatgcaagggccacgcagtattggtggttcgtctactgaagtgaatcaagtagatggtgaatcgatttattgcacagagacgtctttgaataccatgttgaatccagcagacactggatttccaaacaatagtacaccttcaggacgaccaacttatgcaagttcgagttctcatgctgctcaagatcatacctggtggaggtttggggaatccagctccataccaggtccttctgatcaggtcaattccattggaataaagacaagtcaccagctgcctcaagatggtactcaccactttgttggctatggatctgagggaaggcaaacaggtctgaatggtatgatggtagatggaggggttcatgctggcagtcacatcaggaatgtgccgtctttcttgcgcggttcaagttctaatcctatgccacagcatgtagatatgagtatggacatggacagcgataattgtaatgcacagacttccggggtagttatccgtcataatagctatgggagttcattaggaagctcagttcaggccgctggggagagcagcagtggtcctgcttctccatttggtggttggggttcgtcttgcaaaagaaaggctcttgaaggatcccctagtcattatttttctggtgaaactcctaaccgcattgttcagactgaaaatagtgcttcgcatgcaagtctttctcaatatggtgcttcaagtagcttaagtttggctacaccttcacaaagttctccaaatgttactaatcattttggccggacagaacaaatgtttggatctggtggtggaagagcagttgcagccagtgcttttcattctacaagaaacactgacaccttatctagagctggcagacgattaaatcccaggcagcctcaagagtctgtagcattcagcgtatcacatggtgggacttctgtacgtcccactggttctttgcaacagaacttaccattaaactctccttttgtagatcctccagatgtgagatcatcatcaattactagtggctcaaacactggtgagaatcagacaaatatagtccacctcccagctttgaccaggaatatacaccaatatgcttgggatgcttctttcagttctagagccagtaatccttcgggtattgggatgcctgcagagcgattaggaccacagtgggaaacaccgagaagcaaccaagagcagcccttgtttgcacctgcaactgacatgagacagccggtgcatgatctttggaatttcgcacgtggaagccctggttcatctgtagattctctctttgttcctcgagcagggccgagttcagctattcatacgccacagcctaatcccacatggattcctcctcagaatgccccaccacataatccatcgagaacatcagaactttctccttggtctttatttcctagtattgaatctccatctgctagtcatggtggccctcttccattattacccgcaggcccttctgtttcctcaaatgaggtgacaatgccatctagttctaatagccgaagccatcgctcacggcatagaagatcaggtttgttattggagagacaaaatgaacttctccacttgcgtcacatagggaggagcttagctgctgacggtaatggaaggaatcaaatcatttctgagatacgtcaggtgttgcatgccatgagaagaggagaaaatctacgggttgaggattacatggtgttcgatccacttatctaccagggtatgactgacatgcatgataggcatcgggaaatgcggcttgatgtggacaacatgtcgtatgaggagctattggcacttggggaacgcataggtgatgtgagcactggcctaagtgaagaggtcattttgaaagcaatgaaacaacacaaacatacatcttcgtctccttcttctgttgagttgcatcagaacatagagccatgctgcatttgtcaggaagagtatgtagaaggtgataatctaggaaccttgaaatgtggacatgaattccacaaggactgtatcaagcaatgggtcatgatcaagaatctctgccccatttgtaagaccgaagcattaaagacgccgtag

SEQ ID NO: 269 - protein, 704 aa, Arabidopsis thaliana
MNPMQGPRSIGGSSTEVNQVDGESIYCTETSLNTMLNPADTGFPNNSTPSGRPTYASSSSHAAQDHTWWRFGESSSIPGPSDQVNSIGIKTSHQLPQDGTHHFVGYGSEGRQTGLNGMMVDGGVHAGSHIRNVPSFLRGSSSNPMPQHVDMSMDMDSDNCNAQTSGVVIRHNSYGSSLGSSVQAAGESSSGPASPFGGWGSSCKRKALEGSPSHYFSGETPNRIVQTENSASHASLSQYGASSSLSLATPSQSSPNVTNHFGRTEQMFGSGGGRAVAASAFHSTRNTDTLSRAGRRLNPRQPQESVAFSVSHGGTSVRPTGSLQQNLPLNSPFVDPPDVRSSSITSGSNTGENQTNIVHLPALTRNIHQYAWDASFSSRASNPSGIGMPAERLGPQWETPRSNQEQPLFAPATDMRQPVHDLWNFARGSPGSSVDSLFVPRAGPSSAIHTPQPNPTWIPPQNAPPHNPSRTSELSPWSLFPSIESPSASHGGPLPLLPAGPSVSSNEVTMPSSSNSRSHRSRHRRSGLLLERQNELLHLRHIGRSLAADGNGRNQIISEIRQVLHAMRRGENLRVEDYMVFDPLIYQGMTDMHDRHREMRLDVDNMSYEELLALGERIGDVSTGLSEEVILKAMKQHKHTSSSPSSVELHQNIEPCCICQEEYVEGDNLGTLKCGHEFHKDCIKQWVMIKNLCPICKTEALKTP

SEQ ID NO: 270 - DNA, 1107 bp, Arabidopsis thaliana
atgtcttctacaacaatcggcgagcacatcagactccgacgagctagaaaccaaacaatccgtcatctccacgccgccgacgatgatccgccgctaagccacgtcgttcttccgatttcacaacctaatcgcttctgtaactccgcaatgtcttccttctttcccctcccgacttcctcctccaacgaaagcacgaggaagaaaccgtaccaaacgtcgtcgtttcgagggatgggttgctatgccgcagcagcagcagcagctcaagaggtttctgttccctccgtcattcgctactccgcggatttggatgccagaattagaaaagataagaagaagaagaagcataagcataagaaaaagaaaaagaagaataaaggaagctacgaagatggttcgattaggattttaagcgaagaagctagagacgttattgatgtttggtgcagacctggattaggcttctccacggatgctgtaattggtcgatcggttgatcctcctcggggaaggaatattccgtcgtctcgtcgcaaaattgatgtggataacaacaattataatcacacactgggttcttctgttcttcccattcggtttctcaatcaagaaactcattctcatgatatcttcaactctgattctacttttgtgacatcatcacgcgctgaaccaacgatgttgtcaagtagatgtcgtggccatcttccacgctcttaccctgatgatcttaccgagatgaggatgctccagaatggttttgtaatgggaagaataacagattcccgtgataactaccacgaattgaggctcgatgttgatagcatgtcatacgagcaacttcttgagcttggtgatagaattggttatgtgaatactggactaaaagaaagcgagatacatcgttgtcttgggaaaatcaaaccatccgtatcacatactcttgttgatagaaaatgtagcatctgtcaggatgagtatgagagagaggatgaggttggggaattgaactgtggacacagctttcatgtccattgcgtgaaacaatggctttcgaggaagaatgcttgtccggtctgtaagaaggcagcatatggcaagccttaa

SEQ ID NO: 271 - protein, 368 aa, Arabidopsis thaliana
MSSTTIGEHIRLRRARNQTIRHLHAADDDPPLSHVVLPISQPNRFCNSAMSSFFPLPTSSSNESTRKKPYQTSSFRGMGCYAAAAAAAQEVSVPSVIRYSADLDARIRKDKKKKKHKHKKKKKKNKGSYEDGSIRILSEEARDVIDVWCRPGLGFSTDAVIGRSVDPPRGRNIPSSRRKIDVDNNNYNHTLGSSVLPIRFLNQETHSHDIFNSDSTFVTSSRAEPTMLSSRCRGHLPRSYPDDLTEMRMLQNGFVMGRITDSRDNYHELRLDVDSMSYEQLLELGDRIGYVNTGLKESEIHRCLGKIKPSVSHTLVDRKCSICQDEYEREDEVGELNCGHSFHVHCVKQWLSRKNACPVCKKAAYGKP

SEQ ID NO: 272 - DNA, 1578 bp, Arabidopsis thaliana
atggatggatgtgctggtaaacgatctgttgaccggttggttgtgcctcggaaagccagtggtcttaccctgcgtgagaatatgaacaagacagatggtaagaatgttcctttctgcagccgagttggttgtactgcaaaggtaacttctaccaagagatctcggattggctctacggataacaatacaaaagttggtctgcctccggttccatctaccttaaatagaaaggaaattgttgggagctcatctcgtactcctggtggatttggatacttgagaaagccagccaaagttactgcaagaagacagccgtcatctagtttagacactgaatcttcggaaacgagttgtattcatgatgatccagctgcaacagagcccacacttccacgccaaaagactaaaagagtcacaatcaatgttcatcctcaaagcgctgtctctagagaagttgtaataacaaaggcaggaagctcaagtagaggaaccagcagaattagtcatccaaagtctgaattgggtacccgcgatgctctgacgggtccttctgtttctacatcttctggtaacagtgagcacactgtaagaggcggtttgagtaggcatagattgaggaacttgagctgcaattctgtgtctgatgttcttccaactaactcaaactcagcaacaaaaatcagtgtgactaaaaagaaaaacgctgatggagagagcagcttatctagcaaaggtagtaagactagtgtgttggttccaaaggtaaggaatcaaatttcttctcatggcaatggcgtcacagtttctgataacagaagaaatcgagtagtaccaagtattagggacagcagtactgttgtttcaaatggttgtaggagagctggttattttggtagatcagagcgacttggagctactgcatcctctgctacttctcgacaaatgcctcatcctacaacaccaaccgatcccaatccttctctttcgttttgtccatcaaatatatacagtagtactggacgcgtacatagcaatatgcctggtagccccacggaagctgacccttcaagctctttggtgaaccgggatggtttgagtcactacaacatgaatggaattgcagaggtattgttggccctggaaaggattgaacatgatgaagagcttacatatgagcaactggcttctatagagaccaatctattctcaagtggtatgttcagattctatgatcagcatagagatatgaggcttgacatcgataacatgtcatatgaggagttactagctttgggggataaaatgggtacagtgagcacagctctaagcgaagaagcactctcaagaagccttaagcaaagcatttatcaggagacagatgaaaccggttccatctctctgtataaggatgatgatatcaagtgcagtatttgccaggaagagtatgttgatggagatgaattagggactattccatgtcaacatatgtaccatgtgagctgtgtacaacaatggctgcggatgaagaattggtgcccaatctgcaaaacctctgcggaagaagagaagtcgatttag

SEQ ID NO: 273 - protein, 525 aa, Arabidopsis thaliana
MDGCAGKRSVDRLVVPRKASGLTLRENMNKTDGKNVPFCSRVGCTAKVTSTKRSRIGSTDNNTKVGLPPVPSTLNRKEIVGSSSRTPGGFGYLRKPAKVTARRQPSSSLDTESSETSCIHDDPAATEPTLPRQKTKRVTINVHPQSAVSREVVITKAGSSSRGTSRISHPKSELGTRDALTGPSVSTSSGNSEHTVRGGLSRHRLRNLSCNSVSDVLPTNSNSATKISVTKKKNADGESSLSSKGSKTSVLVPKVRNQISSHGNGVTVSDNRRNRVVPSIRDSSTVVSNGCRRAGYFGRSERLGATASSATSRQMPHPTTPTDPNPSLSFCPSNIYSSTGRVHSNMPGSPTEADPSSSLVNRDGLSHYNMNGIAEVLLALERIEHDEELTYEQLASIETNLFSSGMFRFYDQHRDMRLDIDNMSYEELLALGDKMGTVSTALSEEALSRSLKQSIYQETDETGSISLYKDDDIKCSICQEEYVDGDELGTIPCQHMYHVSCVQQWLRMKNWCPICKTSAEEEKSI

SEQ ID NO: 274 - DNA, 1461 bp, Arabidopsis thaliana
atgcgacaaagaaatatgatgactggttcagacatggagcagaattctcaaagctttgttccccatcctgaacctcgcattggaactaactatctgtatccagatatcccaccagtgaacactgttcctcatttagaagctcattctctgcaagaaccttatgataacaactcaatgttctacgggcctccacagtaccatcatcaacatgcttcaaatcttggttctggcatgtcaaccgcaccaaatttctatgtcccttatgtgaattatgaagctccaccgagttttctgttgtctcatggaagtaatgatgcagttgttggagttacttccactgaacatgagagaaatgcccattttatggatcacggattcaaaagaaagagttctgaagtaatacctggaaattctcagtatccagttgctccttgttctttccctcaattgaatacatcggagacagcacctttttcattcccacattttggtacttatccacaaccactagatcagagaagtgtgaggaacagagcaggagcagctacaatggatccacttctctctcatggtcataacaacttcagtcaaggaaactatgcagctcatccttttccacctcttggctcaatctggtatgaccaacactgtaatggcaacagatctgatggatcatcttcgctttggtctcaagcacctgccgtaccttatatgcatggtaacattgctactggatctatagaatctggtaatgtttgcttcccaagataccatgaaacatctagtagcagaaaccccacgccatctgtataccaaaggaaccactatattagccatcaccccgtacctcctcctcccatcgtataccctcacatgccttcagcctcatacgctgagactttgcatcctgcttcatacagtcatatgggacaggttcaatcaaccggattcaggataaaccaatatcccggagaagattttgtacctgcagcaattctaagacaccgtgaattgcctcactttagagcaatgcccgcgaatgaaaatgcattttgggaagtaggagacttctacaatgctgttaattatgtcgatcatcatcaagacatgcgcttagacatagaagatatgtcatatgaggagcttcttgctttgagcgaccagattggaactgtgaagacaggcttgtcatcagaagatgttaaagaacttctgaaaagaagaacctcgaccagaattaacctggaagaaggtccatctactgatctagagactgattcttgcacgatatgccaggaaaactacaagaacgaagataagatcgcaacgctggattgcatgcacaaataccatgcagaatgcttgaagaagtggttggttatcaagaacgtttgcccaatctgtaaatcagaggcattggtcatagagaagaagaagaagctaaggttaagtagtagatga

SEQ ID NO: 275 - protein, 486 aa, Arabidopsis thaliana
MRQRNMMTGSDMEQNSQSFVPHPEPRIGTNYLYPDIPPVNTVPHLEAHSLQEPYDNNSMFYGPPQYHHQHASNLGSGMSTAPNFYVPYVNYEAPPSFLLSHGSNDAVVGVTSTEHERNAHFMDHGFKRKSSEVIPGNSQYPVAPCSFPQLNTSETAPFSFPHFGTYPQPLDQRSVRNRAGAATMDPLLSHGHNNFSQGNYAAHPFPPLGSIWYDQHCNGNRSDGSSSLWSQAPAVPYMHGNIATGSIESGNVCFPRYHETSSSRNPTPSVYQRNHYISHHPVPPPPIVYPHMPSASYAETLHPASYSHMGQVQSTGFRINQYPGEDFVPAAILRHRELPHFRAMPANENAFWEVGDFYNAVNYVDHHQDMRLDIEDMSYEELLALSDQIGTVKTGLSSEDVKELLKRRTSTRINLEEGPSTDLETDSCTICQENYKNEDKIATLDCMHKYHAECLKKWLVIKNVCPICKSEALVIEKKKKLRLSSR

SEQ ID NO: 276 - DNA, 1104 bp, Arabidopsis thaliana
atgccagtttctgcagagccttcttcatcttcttcaacaacaatcggtcaacacatgagactccaacgacctaggaatcatcgaaatctcccacccatttccaccgccgacgaacctctaatccccaaacctagccgcgtctctaaatccgccatgtcttccttcttcctcttgccagaaactactaagaagaaacccaacggaacggcgtcgtttcgtggtctaggctgcacaacctccgcatctcagcaagtttcagtcccggcagtgattcgctcctccgcggattgggatgctagtaatttcaaaattaagaagacgaagaagaagaacaagaacaagggtagtagtagctacaatggtggttcgattaagatcttgagcgaagctagtactagtagtagcgtcgcttgcgcagcgattcctgatgtttggtgtggtcctggagttgggttttcaacggatgctgtcgtcggaggctccattgacacagttgtttcagatcctccgagaaggaatattccggtgagacgcaaaatcgatggagataaaaccaatagtaacagtaataatcatagagagggttcttcttctcttcttcctagacgatctctcaatcaagagtctaatccttattttgattctgattcgagttttttgacatcgcgggctgagcagactgatagatatcatcgtcatctaagactgccttaccctgatggactcgctgagatgatgatgatgcagaatggttttgtgatgggaggagtattaagctcattcgatcaattccgtgacatgaggctcaatgtcgataacatgacatacgagcaacttttggagcttggtgaaagaattgggcatgtgaacactggacttactgaaaaacagatcaaaagttgtcttcggaaagtcaaaccatgccggcaagatacaacagttgctgatagaaagtgcatcatctgtcaagacgagtatgaggcgaaggacgaggtaggggaattacgatgtgggcacaggttccatatcgactgtgtgaatcaatggcttgtgaggaagaactcttgtccggtctgtaaaacgatggcgtacaataagtcttag

SEQ ID NO: 277 - protein, 367 aa, Arabidopsis thaliana
MPVSAEPSSSSSTTIGQHMRLQRPRNHRNLPPISTADEPLIPKPSRVSKSAMSSFFLLPETTKKKPNGTASFRGLGCTTSASQQVSVPAVIRSSADWDASNFKIKKTKKKNKNKGSSSYNGGSIKILSEASTSSSVACAAIPDVWCGPGVGFSTDAVVGGSIDTVVSDPPRRNIPVRRKIDGDKTNSNSNNHREGSSSLLPRRSLNQESNPYFDSDSSFLTSRAEQTDRYHRHLRLPYPDGLAEMMMMQNGFVMGGVLSSFDQFRDMRLNVDNMTYEQLLELGERIGHVNTGLTEKQIKSCLRKVKPCRQDTTVADRKCIICQDEYEAKDEVGELRCGHRFHIDCVNQWLVRKNSCPVCKTMAYNKS

SEQ ID NO: 278 - DNA, 1742 bp, Populus trichocarpa
tgttgcagatttaagggagttataccattcatggatgactattctggtaagagagctggtgatcggttcattgtctccagaaagggatctccccatgttttgagagatactgctaacaatagagatcaaaaagctcagttttgcaaccgaattggatgcagtggcagactgaactctagtaaaggtactcaaataagttcagaaaaagccaaatcttcaaggccaaggccattaatttcatcttcctcgagtggcaaggaaaaaaatggaagctcgtctaataaggctttctctgccatcagcaaacctagaaattccttgcaggaacctcgtaaaaagttttcttctcagctagaatcagaatccttagaaactgggagtggtcaggatgaagttacaccaccttctggaaggattaagttagaccttcgccctgaaaccgatggagctgcttctagtgatattacctcaatggaagctggaagctccggtatatcaaaaagtacaagatctcattggaattttcatcagaaatcaggattggtaaaccccgagactgtagtggggtcacctgtttctttggcatccaaaagcaccattcagggaactcgactgaatgccagcaggtttggtcacagaaatcttagatgcaatacagtatctgattcttcctcttcaggttcttcatcatcagatttaaatctaagtagacggaaagacacattcaacaagagaatttgtgatggagaaagtagttcctttgccagggggaaaaggatgattgggtcttcattagaagggcggagttctagttcaaattccggtatctccatttctgattcaaggcgagctagaactggaactttgaatagggatagcagtgctgcatcaattgggtctcgaagaccactcagtggctacacgagggcaagggtcgctaaccaaggaagtggaaacaatttatcagcaaatgagatcccactaacatctcaacctgatatgtccctggatttgaatgctccgagttcatcacaccacttctcagtggaagcctctttaggccgcccaagttcttatagtcgacctggcagtagcaatgggagtttacggggtattaggccatccagtccagaagttagcaatgcccaatctttgatgaatcgtgagagcttccagcgctacaatatggttgggattgctgaggtattattggcactccagaggattgaacaagatgaagaactaacatacgagcaattgcttgttttggagaccagtttggtccttaatggactaaacttccatgatcaacatagagacatgagactggatatcgacaatatgtcatatgaggaactattagctcttgaagagagaatgggtactgtgagcacagcactaacagaggaagccttgtcagaatgcctcaagactagcatttatcattccactcctatggaggatgcgactgcaaaccttgaaggtgataaggatgacatcaagtgcagcatctgtcaggaagagtatgttgttggagatgaagtgggaaggttacaatgtgagcatggatatcacatgtcctgcatacatcaatggctaagtctgaaaaattggtgccctatttgcaaggcatcagtggctccgtcgccaccatcctcgtaaacaattaataaactggatgcaggcgactggctttttcattttgtacaaaataagtctgtcaccttcatctttttttcttt

SEQ ID NO: 279 - protein, 543 aa, Populus trichocarpa
MDDYSGKRAGDRFIVSRKGSPHVLRDTANNRDQKAQFCNRIGCSGRLNSSKGTQISSEKAKSSRPRPLISSSSSGKEKNGSSSNKAFSAISKPRNSLQEPRKKFSSQLESESLETGSGQDEVTPPSGRIKLDLRPETDGAASSDITSMEAGSSGISKSTRSHWNFHQKSGLVNPETVVGSPVSLASKSTIQGTRLNASRFGHRNLRCNTVSDSSSSGSSSSDLNLSRRKDTFNKRICDGESSSFARGKRMIGSSLEGRSSSSNSGISISDSRRARTGTLNRDSSAASIGSRRPLSGYTRARVANQGSGNNLSANEIPLTSQPDMSLDLNAPSSSHHFSVEASLGRPSSYSRPGSSNGSLRGIRPSSPEVSNAQSLMNRESFQRYNMVGIAEVLLALQRIEQDEELTYEQLLVLETSLVLNGLNFHDQHRDMRLDIDNMSYEELLALEERMGTVSTALTEEALSECLKTSIYHSTPMEDATANLEGDKDDIKCSICQEEYVVGDEVGRLQCEHGYHMSCIHQWLSLKNWCPICKASVAPSPPSS

SEQ ID NO: 280 - DNA, 476 bp, Populus trichocarpa
taacttccgcttctgcttgtgcaggatgttatgattcttgaccaatcagttttgtttggagcagctgacatgtatgataggcatagggatatgcggcttgatgttgataacatgtcttatgaggagttgctggctttggaagagcgcattggaaatgtcagtactggattgagcgaagaaactatagtaaacaacttaaaacagcagaaatactctgttgctgttggagcgaaggtggaggctgaaccatgctgcatttgccaggaggaatacaatgatggagaagatcttggaacactggactgcggacatgatttccacgcggggtgtgttaagcagtggctgatgcacaagaattggtgccccatctgcaaaacaacaggacttgctacatgagaaagggtaaagatgttcaggccattacacacggttggtacacggttgtacgaggaaaacgtgagaggcgtggccctaga

SEQ ID NO: 281 - protein, 121 aa, Populus trichocarpa
MILDQSVLFGAADMYDRHRDMRLDVDNMSYEELLALEERIGNVSTGLSEETIVNNLKQQKYSVAVGAKVEAEPCCICQEEYNDGEDLGTLDCGHDFHAGCVKQWLMHKNWCPICKTTGLAT

SEQ ID NO: 282 - DNA, 2210 bp, Populus trichocarpa
gttatgagtcagcaaacacctttcagtaacatgctaaatccagtggatagcagattgtcaaataatgctgtatcttcgggcaacgcatcgtgctcaaatgctttaactcacgatgtccagagctttagtggttggaattcaggcgaatctagctcaaggttaagtctgcaaaatcaggtgaatgatgatgggataaaaatggaagaatggttgtctacttcagtcaatgcttatcctgcagttggtcaaagatcagaggaaaggctatttgaaacaactaatatccttttcccaggcagagtcagtacggggattagtggcaatcaggttagaagtggacctttattcttgcagggctccagctcgaatcatatcgcacccaatgtatgtccaaattctggtcatattggagacaccactattggcagacccattacaggagctgtcttaggccttaatcaactcaaccctggtggtggattagaaatagaacgggcatcttcttctggtgtttcttcttctgatgttggcacttcatctggaagttctggttatatagtagaggagacaaatggtggttcaggatcttctattggggtttggggcttatcctgcaagagaaaggcccttgaaggtactactggacagtcttttcctggtggaagttcaagttgctttccacaagctgaaagtagtgcatggcataatggacccaataatcacagtgtttctagcagcctaagtttatccactccctcaccgaatactccaagtgttgctcctcctgaacagttgaacccaagatttggttatggaatgagaggagcacctcctgatgcatttccttcatcaaatgttagtggaaatgcagactctctgagaaattttggtaggaggataagtcctggacatcaacaggaatctgtcactttcaatttgtcaacaacaggaggttccaggcgttggtccttgcagcattctcgcagacctgtctcagttagtgactatctggagtcaagatcaacagaacctgcaaattcaagtgccatccaaggccagcttcatgctatcaacccttcttctttatcaagcagtttgccttgttgggatgatttttcaagttcaagagttggaaattcattgagttcccttatacctggagagctaggtgctgcatcaagagaggaagcaaacttaagaagctttcagacaaataatgcagaccatccaatgtttgcacctgcaactgaaatgagaagaatgggacaagatccaacacgctggggtttggccactgggaacatgagtgcctcgggtagtgtttcttctaccagaattggttcttctaccagaatgggccccagttcaagtgtccatccttttcctactcccggatggattcatcacaaccccacaacacataatcagcaaagaatttctgaattttctacttggtctctgttcccacctatggcctctgaatctggaggtcacagttgccatttctcccctttgtcttctggtccttcctctgcacaggacacacagatttcttctggatctagtagccagggacataatccaccaccatttccaaggtcagcatttctcacggaagaacaaagtgatgatgttcttggaatgccccgttccttgagggctttagctgctgatattgaagggagacatcggctcatatctgagattcgtcaagtattgaatgccatgcgcaggggtgaaaatcttcgtgttgaggactacatgctttttgacccgatgatctatcatgggatggctgaaatgcatgatcggcatagagatatgcgccttgatgttgataatatgtcttatgaggaattgttggcattggaagaacgcataggagatgtgagcactggactaagtgaggaaaccattttgaagttactgaaacaggaaaaacatgtgccgatcagcacagaatctccagcagatttggagccttgctgtatctgtcaggaggaatatgtggatggggatgatatgggaataatcgactgtgggcatgactttcataccaactgcatcaaacagtggctaatgcagaaaaatctatgtccaatttgtaagatgacggccctgctcacttgagagggaagataatgccagttcctggaaattttattttcttaaaaacaaatcaacatccaaatactgggtggatgatatcc

SEQ ID NO: 283 - protein, 708 aa, Populus trichocarpa
MSQQTPFSNMLNPVDSRLSNNAVSSGNASCSNALTHDVQSFSGWNSGESSSRLSLQNQVNDDGIKMEEWLSTSVNAYPAVGQRSEERLFETTNILFPGRVSTGISGNQVRSGPLFLQGSSSNHIAPNVCPNSGHIGDTTIGRPITGAVLGLNQLNPGGGLEIERASSSGVSSSDVGTSSGSSGYIVEETNGGSGSSIGVWGLSCKRKALEGTTGQSFPGGSSSCFPQAESSAWHNGPNNHSVSSSLSLSTPSPNTPSVAPPEQLNPRFGYGMRGAPPDAFPSSNVSGNADSLRNFGRRISPGHQQESVTFNLSTTGGSRRWSLQHSRRPVSVSDYLESRSTEPANSSAIQGQLHAINPSSLSSSLPCWDDFSSSRVGNSLSSLIPGELGAASREEANLRSFQTNNADHPMFAPATEMRRMGQDPTRWGLATGNMSASGSVSSTRIGSSTRMGPSSSVHPFPTPGWIHHNPTTHNQQRISEFSTWSLFPPMASESGGHSCHFSPLSSGPSSAQDTQISSGSSSQGHNPPPFPRSAFLTEEQSDDVLGMPRSLRALAADIEGRHRLISEIRQVLNAMRRGENLRVEDYMLFDPMIYHGMAEMHDRHRDMRLDVDNMSYEELLALEERIGDVSTGLSEETILKLLKQEKHVPISTESPADLEPCCICQEEYVDGDDMGIIDCGHDFHTNCIKQWLMQKNLCPICKMTALLT

SEQ ID NO: 284 - DNA, 1247 bp, Populus trichocarpa
ctctccctctcattgacaaagcacaaagatatgccggtttttgcagagagcagcaacacaactatagctgaccaaatcaagctaagaaaacacagagagctgcaacccattgcaactgaaacagatccaaacccacatatctctaggacctccaaatccaatacaataatctcctccctcttccactctcacttcactgcaaccccacctgaccaaacaaagaagaaaggtgcaacctttagaggcctaggatgcactgctggagcagcacagcaggtgtcggtgccggcggtgataaggtcatcggctggctgggaagggaaaagggtcaagaagaaaaagggtcatcagaaaagaaagaaagaaagcttgaaactttccagtgacaacaacaacaatagtaataatagcaatggtgatggtgatcttagtggagatggtaatcttgggaattgcatggttatgcaagatgtttggtgtggacctggaattgggttttcaggtgctgatgctgttgttgggtcagttgactgtgttgtcgttagaaggaacgcgtcatccggaagagggaagattgatgaaggagagaaatttaatcaaagggaaagagagagggggagagagagagagcgtccttgtttatctaggcgggctgcagtgaatcctgaaaccccctcgtttctggatactgatcctgcttttgtaacatctcgtcctgaaatagaagtttttggaactcggtattatcgccatatccgacatccttccccagatggacttgctaggatgatgatgctccagaatagttttatcatgggaggaagattggatcgatttagcaactggagacttgatattgatcacatgacatatgagcaactgctcgatttaggtgatagaattggttatgtgaatactggattgaaagaagatgagatcagcagctgtgtcaagaaaattaatccctcaatcatcgaagaactgccatcacatttacacatgacattggaaaagaagtgcagcatttgtcaggatgagttcgaagaagctgatgagttaggcaaactagattgtggacatggttttcacatacaatgtataaagaaatggcttgcacagaaaaatacatgcccggtctgtaaaactgaaccggtggctcgagcctaatatcttcaaactgctgctatttacctgttggtgtgtatagatttcatttcctatacgtattcaagcatccattctttagc

SEQ ID NO: 285 - protein, 708 aa, Populus trichocarpa; identical to SEQ ID NO: 283

SEQ ID NO: 286 - DNA, 2297 bp, Populus trichocarpa
cattatattagggggaacacattgtgcctgatgcataggcaaaggggtgcatttcataccttttctgaaactattgacattgatcagggatctgtttcagacaatatcggtacaagtcagcaaacttcttttggtaacatgctaaatccagtagatagcagattgtcaaataatgctgtatcttctggcgatgtatcatgttcaaatgctatgactcatgatattcagaacttcagtggctggaattcaggtgaatctagctcaagtttaagtttgcaaaatcagctgaatgatgatgagataaaaacggaagaaaggtggtcttcttcagtcaatgcttaccctgcagttggtcaaagatcagatgaaaggctatttgaaacaactgatatcctttttccaggtagaggcaatatggggatcagtggcaatcaggttaggagtggacctctattcttgcagggctccagctctaatcatatcccaccaaatgaaagtccaaatgctggtcatattggagacaccattaatggcaggcctattacaggagctgtcttaggccttaatcgtctcaaccctggtggattagaaatagagttggcatcatcttctggtgtttcttctgatgatgttggcacttcatctggaagttctggttgtatagtagaggagacaaatggcggtccaggatcttctctggggggttggggcttatcctgcaagagaaaggcccttgaaggtacttctggacagtcttttcctggtgcaagctcaagttgctttccacaagctgaaaacagtgcatggcataatggccccaataatcatagtgtttctagcagcttaagtttatccactcccacttggaatgctcctagtgttactcctcctgaacagttgaacccaagatttggttatggaatgagagcagcaccttctgatgcgtttccttcatcaaatgttagtggaaatgcggacactctgagaaattttgataggaggacaagtccaggacttcaacaggaatctgccgctttcaatgtatcaacaacaggaggttccaggcgatggtccttgcagcaccctcccagacctgtctcagttagtgactatctggagtcaagatcaccagaacctgcaaattcaaatgctactcagggccaacttcatgccataaacccatctgctttatctagaagcatgcttcggtggaatgatttttcaagttcgagagttggaaattcaccaagttccctcatccctggagagctaggtgctgcattaagagaagaaacaaactcaagaagatttcagagaaataatgcagagcatccaatgtttgcacctgcaactgaaatgagaagcatgatacaagatccaacatgctggggtttggccactgggaacatgagcacctcaggtagtgtttcttctaccagaattggccccagttcaagtgtccgtccgtttcccactcctcgatggattcatcgcaatcctacaacacataatcagcaaagattctcagaattttctacttggtctcttttcccaccaatggactcagaacctggaggtcatagtggtcatttctccccattgtcttctggtccttcttcttctgcacaggacacagtgatttcttccggatctaatagccagggacataatccaccatttccaaggtcagcacttctcatggaagaacaaagtgatgacattcttggtatgccccgttcattgagggttttagctgctgatattgaagggagacatcggctaatatctgagattcgtcaagtgttgaatgccatgcgcaggggtgaaaaccttcgagttgaggattatatgctttttgacccgttgatctatcatgggatggctgaaatgcatgatcagcatagggatatgcgcctcgatgttgataacatgtcctatgaggaattgttggcattggaagaacgcataggagacgtgagcactggactaagtggggaaaccattttgaagttaatgaagaagcaaaagcatgtgcctgttagcacagaatctccagcagatttggagccttgctgtatctgtcaggaagaatatgtggatggggatgatatgggaataatcgattgtggacatgactttcatgccaactgcatcaaacagtggctaatgcagaaaaacctttgtcccatttgtaagatgacagccctaatcacttgagagggaagatattgtcaggtcctgggaattttattttcttaaaaacggacaatcatatccaaaacctgggtagatggtat

SEQ ID NO: 287 - protein, 728 aa, Populus trichocarpa
MHRQRGAFHTFSETIDIDQGSVSDNIGTSQQTSFGNMLNPVDSRLSNNAVSSGDVSCSNAMTHDIQNFSGWNSGESSSSLSLQNQLNDDEIKTEERWSSSVNAYPAVGQRSDERLFETTDILFPGRGNMGISGNQVRSGPLFLQGSSSNHIPPNESPNAGHIGDTINGRPITGAVLGLNRLNPGGLEIELASSSGVSSDDVGTSSGSSGCIVEETNGGPGSSLGGWGLSCKRKALEGTSGQSFPGASSSCFPQAENSAWHNGPNNHSVSSSLSLSTPTWNAPSVTPPEQLNPRFGYGMRAAPSDAFPSSNVSGNADTLRNFDRRTSPGLQQESAAFNVSTTGGSRRWSLQHPPRPVSVSDYLESRSPEPANSNATQGQLHAINPSALSRSMLRWNDFSSSRVGNSPSSLIPGELGAALREETNSRRFQRNNAEHPMFAPATEMRSMIQDPTCWGLATGNMSTSGSVSSTRIGPSSSVRPFPTPRWIHRNPTTHNQQRFSEFSTWSLFPPMDSEPGGHSGHFSPLSSGPSSSAQDTVISSGSNSQGHNPPFPRSALLMEEQSDDILGMPRSLRVLAADIEGRHRLISEIRQVLNAMRRGENLRVEDYMLFDPLIYHGMAEMHDQHRDMRLDVDNMSYEELLALEERIGDVSTGLSGETILKLMKKQKHVPVSTESPADLEPCCICQEEYVDGDDMGIIDCGHDFHANCIKQWLMQKNLCPICKMTALIT

SEQ ID NO: 288 - DNA, 1280 bp, Populus trichocarpa
cctctctctgataaacaaagcacaaagatcatgccagtttttgcagagagcagtagcagcacaccagcagctatagcagaccaaatcaagctaagaaaacccagaagccaacaagagctgcaacccatttcaactgaaacagatccaaacccacatgcttccaagtcatccaaatccaacacaattatctcctccctcttccactctcacttctctacaaccccacctgaccaatccaagaagaaaggtgccacctttagaggcctaggatgcactgctggagcagctcagcaagtatcggtgccggcggtgataaggtcatccgcggactgggaagggaaaaaggtcaagaagaaaaagggccatccaaaaagaaagaaagagagcttgaaactttgcagtgacaacaacaatactagtaatagcaatggtgatgttaatggagatggtaattttgcgaattgtatggttatgcaagatgtttggtgcggacctggaatggggttatctggtgctgatgctgttgttgggtcagttgactgtgttgtggctagaagaaacgtgtcaattggtagaggaaagattgacggaggagagaaaattaatcaaagggaaagagagagggagagggagagggagagggatagagagagggagagggagcgtccttgtatagttaggcgggcagcagttaatcctgaaactctttcatttctggatactgatcctgcctttataacatctcgtcctgagccagaagtttttggaactcggtattatcgccatattcgacatccttccccagatggacttgctgagataatgatgctccaaaatagtttcatcatgggaggaagaatggatcgatttagcaactggagactagatattgatcacatgacatacgagcaactgctcgatttaggtgatagaattggttatgtgaatactggattgaaagaagatgagatcagccgctgtgttaagaaaattaatccctcattcatcaaggaactgtcatcacatttacccatggtattggaaaagaagtgcagcatttgtcaggatgactacgaagaagatggtgaggtgggaaaacttgattgtggacatggctttcacatacaatgcataaagcaatggcttggacagaaaaatacctgcccagtatgtaagacagaaccggtgggtcgaggctagtatcttcaaactgctgccatttacccgttggtgtgtatagatttcatttcctatacgtaatcaagcattcattctttggc

SEQ ID NO: 289 - protein, 389 aa, Populus trichocarpa
MPVFAESSSSTPAAIADQIKLRKPRSQQELQPISTETDPNPHASKSSKSNTIISSLFHSHFSTTPPDQSKKKGATFRGLGCTAGAAQQVSVPAVIRSSADWEGKKVKKKKGHPKRKKESLKLCSDNNNTSNSNGDVNGDGNFANCMVMQDVWCGPGMGLSGADAVVGSVDCVVARRNVSIGRGKIDGGEKINQRERERERERERDRERERERPCIVRRAAVNPETLSFLDTDPAFITSRPEPEVFGTRYYRHIRHPSPDGLAEIMMLQNSFIMGGRMDRFSNWRLDIDHMTYEQLLDLGDRIGYVNTGLKEDEISRCVKKINPSFIKELSSHLPMVLEKKCSICQDDYEEDGEVGKLDCGHGFHIQCIKQWLGQKNTCPVCKTEPVGRG

SEQ ID NO: 290 - DNA, 1748 bp, Populus trichocarpa
agcttaaattatcttctgctgtaaggggtcatgggacatagacaaatgttcaacccttctcaattcttcgagatggagcaggattggagccatggccacccagctgctggacagtcctatgttcatatgggaagggctgtttctcaagaaaatggttccttttctcatcctatcaatcctccttcaatagatggacccagctgtgcctctcggcggaacctggaaaacagagctcttgagcattcctctacatatttcaggtcagaaggtccgcaagttcacgctcccctttctgccccccgacatgatgtattcccacactgtccagctggtggaagcttttaccctcctccagagctcgaagctacccatgttcattctaatcaccacaacaggcatggtatccatgaaggtgagggtggtctccttgatcatacaatgagtgctggaagagggccattcaaaagaaaaagccctggtgttcctacctcgtgggaaagaggtggcaccagcagtatgtacagtgcaggaagttcctccaattcttttgaacttcaccatgagaaaccaacttcagattatagaaattacttttcagaatcctctggtttacctccctatatgggtagcagcctgtcaattgggggtgaagatcctccaaggaatgtgagaagcagatctagacttgatttggagcccaacccaaggagaacccattcatcaagttacacgtcccatcctttttcttcaacatctcatctccgaaaccatccagggccagtggatgttgctaacttaaatgctgacagaactgcttatgagcagaaccaaattggtgttccacctcctgcacatgggaggtttcatacttcagaaaataattccttgagccatgagatgaatcagcattatgctggagggaatcctactgatattcgtcggtacaaccatgattccatcttaagcagaaatcccattgcaccaccacgacatcttcatggttttcatgcccaggcttcaagggagggtcagaacagttattctcgaagagctatacctacacgtcgggctgatataaactcctctcatctcagacaagaagctgctgctgtcgaaaatggtcagcattttctatcagaaacccatagttccagatattcaagaccacttttgtctggaggttggcacagcaatcatagagaaggaaggtcaaggatatcaattgagagattccagtctctttcaaatgtggtggatgtgcgtgatagaatgggatctgaggctcttatgatgttagatcactcatatttatatggctccagaaatttccttgatcaatacagggacatgagactggatgttgacagcatgagttatgaggaactacttgctctaggagaaaggatagggattgtcaacacaggattgcctgaagatgtgttttcaaagtgcttggtggagacaagatgccattcttcagacaaagcccaggaagaaacatcctgtgccatatgccttgaagagtacaagagcatggataaagttggaatgataaggaactgtggacatgtttatcacgtcgactgcatcaagaagtggttgtcaatgaagaatatgtgccccatctgcaaagcacctgctgttgctgatggttcgaacaaggaatgatttgcttttacttcctctatttgatcttgttcactttatcttgtatataataatttggtgatgggatttgatgaccattt

SEQ ID NO: 291 - protein, 545 aa, Populus trichocarpa
MGHRQMFNPSQFFEMEQDWSHGHPAAGQSYVHMGRAVSQENGSFSHPINPPSIDGPSCASRRNLENRALEHSSTYFRSEGPQVHAPLSAPRHDVFPHCPAGGSFYPPPELEATHVHSNHHNRHGIHEGEGGLLDHTMSAGRGPFKRKSPGVPTSWERGGTSSMYSAGSSSNSFELHHEKPTSDYRNYFSESSGLPPYMGSSLSIGGEDPPRNVRSRSRLDLEPNPRRTHSSSYTSHPFSSTSHLRNHPGPVDVANLNADRTAYEQNQIGVPPPAHGRFHTSENNSLSHEMNQHYAGGNPTDIRRYNHDSILSRNPIAPPRHLHGFHAQASREGQNSYSRRAIPTRRADINSSHLRQEAAAVENGQHFLSETHSSRYSRPLLSGGWHSNHREGRSRISIERFQSLSNVVDVRDRMGSEALMMLDHSYLYGSRNFLDQYRDMRLDVDSMSYEELLALGERIGIVNTGLPEDVFSKCLVETRCHSSDKAQEETSCAICLEEYKSMDKVGMIRNCGHVYHVDCIKKWLSMKNMCPICKAPAVADGSNKE

SEQ ID NO: 292 - DNA, 1766 bp, Populus trichocarpa
cttggctatgaagcagggataatttgagatatgggacaaagaaacatgctatgcaccaatcagatgattgatttagaaatggatcaacaaagccagggatatctacatcctgagccttgcatccttttagggggtgtgacaaacttccgaccatctgatattccaaccatggtagcagcttcagggaacactaacaatcgtgacgctcatctagtggatcattatgatggtgctatgttttatggtatgccccaataccatggtcttcatccccatcgtcaatatcatggcccaaatcttgatttaagtgttgctactgcacccaacttctatgttccttacatgactccatcttctggtattcctatcagtcatgggccttgtgatcagttatcatcttccaacaattatggagtgattgaagtttctgctgatgagtatggaacaaacagtcacttcatggataatgctagaggttcattcaaaagaaagaatgctgaaggaaacccagggaatttccagtatctgaatgcatcggcaagctctagttcttcagttgccccattgaatactaggcattctgaggggggtgctctgatggatgctacatcattcaccccgccacattaccgagggagcagtgcttcatcaatcagagatgtgggatctcaaagcagtgtgaggaatagattaggtgctgctgggttagatcctgctctggcgcacaatctaaaccattttattcaaggaaactatttgggtcaaccctatcagccaagtggctctctttggctagatcaacatttaagcaacagtggtactgatgcaggcacttcaggatggactcagaccactgctattccttacatgcatgggaacaatctcaatggaggtcctatagaaattggaaatatgggtctacagcggtatcatgagccagctagcaacagaagtaatgccagtttctcccgcccttctgcagtgaaccttcagcatcacaattttcatcatatgtctccaccaattcaaggaatgagaggccacaatattaatattcttcctcaagcaccagcagcttcattcagagttcctacagccaatgcctcacaaatcaccatgaatccatctcaagatggtttagatattggacttaggcatctaggatcagttcaaccaactggccttagaatgtacaggtctcaccgtgagggagttgtacctgagaccaccctaagacatcgcaacctccctcagttgagagtattgccaacagatggggtagcaatattagggttccctgactattatgaagtagagaatcatgttgaccaccacagagatatgcgcttggatatagaggacatgtcttatgaggagcttcttgcactaggggagcgaattggcaatgtaaatactggattgtcagagggaaccatcagaagccaattaaaaacaaggacttatttatcatctccttcaatcaatttggaagaggcagcttgtatggatcaagaagctgattcttgtattatttgccaggatgattataagagcaaggagaaaattgcagctcttgattgtggacatgagtatcatgcagtttgcttgaagaagtggctacgcttgaagaatgtctgccccatctgcaaatcagaagccttaaacacggaaagaatggatgtttaaggtggtgatcttgctttatataaaatgaaaggaaaaataaagtagaggaaaggggtgacagtttctttctcataatttgt

SEQ ID NO: 293 - protein, 551 aa, Populus trichocarpa
MGQRNMLCTNQMIDLEMDQQSQGYLHPEPCILLGGVTNFRPSDIPTMVAASGNTNNRDAHLVDHYDGAMFYGMPQYHGLHPHRQYHGPNLDLSVATAPNFYVPYMTPSSGIPISHGPCDQLSSSNNYGVIEVSADEYGTNSHFMDNARGSFKRKNAEGNPGNFQYLNASASSSSSVAPLNTRHSEGGALMDATSFTPPHYRGSSASSIRDVGSQSSVRNRLGAAGLDPALAHNLNHFIQGNYLGQPYQPSGSLWLDQHLSNSGTDAGTSGWTQTTAIPYMHGNNLNGGPIEIGNMGLQRYHEPASNRSNASFSRPSAVNLQHHNFHHMSPPIQGMRGHNINILPQAPAASFRVPTANASQITMNPSQDGLDIGLRHLGSVQPTGLRMYRSHREGVVPETTLRHRNLPQLRVLPTDGVAILGFPDYYEVENHVDHHRDMRLDIEDMSYEELLALGERIGNVNTGLSEGTIRSQLKTRTYLSSPSINLEEAACMDQEADSCIICQDDYKSKEKIAALDCGHEYHAVCLKKWLRLKNVCPICKSEALNTERMDV

SEQ ID NO: 294 - DNA, 1763 bp, Populus trichocarpa
cttggctatgaagcaggtataatttgagatatgggacaaagaaacatgctatgcaccaatcagatgattgatttagaaatggatcaacaaagccagggatatctacatcctgagtcctgcattcttctagggggtgtgacaaacttccgaccacctgatattcctaccatgttaacagcttcagggaacactatcaatcgtgacgcccatctagctgatcgttatgatggtgctatgttttatgggatgccccaataccatggtgttcatcctcatcctcagtatcacagcccaaatcttgatttaagtgtggctactgcacccaacttctatgttccttacatgactccatcttctggtattcctatcagtcatgcatcttgtgatcaattatcttcatccaacaattatggagtgattggagtttctgctgatgagtatggaacaaacagtcacttcatggataatgctagaagttcatacaagagaaagaatgctgaaggaaatccagggaatttccactatctgaatgcctcagcaagctctagttcctcagttcccccaatgaatacaaggcatcccgagggggttgctctgatggatgctacatcattcaccctgccacattacagggggactagtgcttcatcaatcagggaagtaggatctcaaagaagtgtgaggaatagattaggttctgtggggctcgatcctgccttgacacacaacccgaaccattttattcaaggaaactatttgggccaaccctatcagccaggtggctctctctggttagaacaacacttaagcaacggttctactgatgcaggcgcttcagtatggactcagacccctactattccttacatgcacgggaacaatgtcaatggagttcctatagaaactgggagcatgggtccacagcggtatcatgagccagctagcaacagaagtaatgccagtttctcgcacccttctccagtaaaccctcagcaccataattttcatcacctgtctccaccaattcaaggaattagaggtcacaatattaatattcttcctcaagcaccagcagcttcattcagagttcctacagccaatgcctcacaaagcactatgaatctatctcaagatggtttagatattggacttaggaatccgggatctgttcaaccaaccggccttcgaatgtaccggcctcgccatgagggagttgcacctgagaccacactaagacatcgcaacctccctcgcttaagagtgttgccaacagatgcaacaatactagggttccctgactattatgaagtagagaattatgctgaccaccacagagatatgcgcttggatatagaggacatgtcttatgaggagcttcttgcacttggggagcgtattggtaatgtaaatactggcttatcagatgcaactatcagaagtcaattaaaaacaagaacttatttatcatctccttattcaatcaatttggaagtatcttgtatggatcaagaagctgattcttgcattatttgccaggatgattataagagtaaggagaaaattgcatctcttgattgtggacacgagtatcatgcagattgcttgaagaagtggctacgcttgaagaatgtctgccccatctgcaaatctgaagccttaaccatggaaggaaaggatgtttaaggtggtgatcctgcttgtataaaataaaaggaaaaataaagcggaggaaaggggtgacagctttataggcgagcattcaa

SEQ ID NO: 295 - protein, 550 aa, Populus trichocarpa
MGQRNMLCTNQMIDLEMDQQSQGYLHPESCILLGGVTNFRPPDIPTMLTASGNTINRDAHLADRYDGAMFYGMPQYHGVHPHPQYHSPNLDLSVATAPNFYVPYMTPSSGIPISHASCDQLSSSNNYGVIGVSADEYGTNSHFMDNARSSYKRKNAEGNPGNFHYLNASASSSSSVPPMNTRHPEGVALMDATSFTLPHYRGTSASSIREVGSQRSVRNRLGSVGLDPALTHNPNHFIQGNYLGQPYQPGGSLWLEQHLSNGSTDAGASVWTQTPTIPYMHGNNVNGVPIETGSMGPQRYHEPASNRSNASFSHPSPVNPQHHNFHHLSPPIQGIRGHNINILPQAPAASFRVPTANASQSTMNLSQDGLDIGLRNPGSVQPTGLRMYRPRHEGVAPETTLRHRNLPRLRVLPTDATILGFPDYYEVENYADHHRDMRLDIEDMSYEELLALGERIGNVNTGLSDATIRSQLKTRTYLSSPYSINLEVSCMDQEADSCIICQDDYKSKEKIASLDCGHEYHADCLKKWLRLKNVCPICKSEALTMEGKDV

SEQ ID NO: 296 - DNA, 743 bp, Populus trichocarpa
atttcaagatattatcagtagtcttattcgatggacaatgatgggagaaaagagccggtggaggatgaagagagaaaacaggcatcgagtagggtctgttatacccaactcgaacaggttcattcagattttgcaatagcaatggttttgcaggaacaagaaagggctttcacaatcctcacaagcatcgaaagcgatagtaacgaggaagaaagtgatgaagcttcaagttctgaaagcggtgctgatgacaatgactatgagttctttcagagccatgaattcgaatctgaaatggaatttctgcaggaaggagaggatagtaacagcgatgaagatatggaagaggatgaggttgacccagacgagctatcttacgaagacttgattgcgctgggagagtttgtagggcaagagaagaggggactgtcaagaaatgaaatctctacgtgcttgcgtccatgtaagtacgagtctttagcaagcaaaactgggactgatcggtgtgtgatttgtcaaatggaatatgaagaagatgaatcattggtagctctttcttgtgatcatccttatcatcctgaatgcatagccaactggcttcaaatcaataagatttgccccatttgtaccaccgaagtatcatcgccttataagagtgtttagttattatccatttgatatgcgttgtaaaattcccaagattcaagattaatttgattgtaacatttgcgttcatgtactcg

SEQ ID NO: 297 - protein, 210 aa, Populus trichocarpa
MDNDGRKEPVEDEERKQASSRVCYTQLEQVHSDFAIAMVLQEQERAFTILTSIESDSNEEESDEASSSESGADDNDYEFFQSHEFESEMEFLQEGEDSNSDEDMEEDEVDPDELSYEDLIALGEFVGQEKRGLSRNEISTCLRPCKYESLASKTGTDRCVICQMEYEEDESLVALSCDHPYHPECIANWLQINKICPICTTEVSSPYKSV

SEQ ID NO: 298 - DNA, 1805 bp, Medicago truncatula
atggatgaatattctagtaagagagccaatgatggggtgatagttcctagaaaggggatgagcaccatgtttaaagatactgccactacccgagatcgaaatggtcaagtatgtagccgccttggttgcagcagcaaagtcaactcttctaaaggtgctcaaattggttcttctgaaaagggtaaatctttgaggccttcatttcggttctcatcaaatggcaaggaaacaattggtagctcctctagaacgttctccgggagtagtagcccaggaaaaccccatagaaagcctcagaaaaagttatcatctcagatagagacagattcatctgaaactaatagtgtacaagatgaaccagaagtttcaaagctcacacctccacaaaaaaaccagaggggtcttcaagccgaaggggaaaacacagattctagtaatggggtgctgatggaagtaggaagttctagtttagcctctaatacaagatctaggaggaattttcatccaaaacctggattacgtagtcaagaaattcaaagcaccggtccagggacacgtgctggtaccagtaggtatgggttaaggaacctcaaatgcaactccatttctgatgtcatgcccgtcggttgtacaccatctgattcaaccctaaacaaaaagaaggatgcgataaaaaagagaaattgtgaaggagaaagtagttctacagctagaggcaaaaaaattaacgggccgttaattgatggacggaattctgtatccagaaatggcctatctatctctgattcaagaatatctagaaatgcccctcatagggacagggcagacagcaacatagcgtctggtagaacacgaagatcaattggcggtcatggtaggggaagggtttctggccaaggaaatgctaatcctgtggcccctaatcagtcccttatcatggtaccttccttttcttattctggaaatcttaattctcctggtgtacaacatcataattctctggagactccttcaagtccaagttcttacagtggagcaggtactagtagtgaggaactgtacggtgttatgccaacgtctcctacagaatacgggctcacccattctctaataaatcgggatagctttcgacgacgctacaacatggatggtattgcagaggtactgttggcacttgagaggattgaacaagatgtcgagctaacacacgagcaaattcacttgttggagtccaacttgttccttactggactaaacttctttgatcagcatagagatatgcgactggacatcgataatatgtcatatgaggaattactggctctggaagaaaggatgggtactgtgagcaccgctgtaacagaggaagatctatcagaatgcctaaagagaagtttctatcaatcctcaccctcagacaatgcaaccaagtgttgcaatgagaataaggatgatatcaaatgctgcatctgccaggaggagtatgtggaggaagatgaagtggggagtctactatgcgagcacaaatatcatgttgtttgcatacagcagtggctacgactaaagaactggtgtcctatttgcaaagcatcagtgacaccgtcaagttcgccgtcgtcccactagttatgttttaggccagacaatggatattgatttctttctacccctctttctgttcattttaattttcacttttgtacaaaatacagtttctcttcacctcttcttattagtcttttgtacataaccaatatcttcataccaattattatcaaataatacaagccactggcttgatagat

SEQ ID NO: 299 - protein, 541 aa, Medicago truncatula
MDEYSSKRANDGVIVPRKGMSTMFKDTATTRDRNGQVCSRLGCSSKVNSSKGAQIGSSEKGKSLRPSFRFSSNGKETIGSSSRTFSGSSSPGKPHRKPQKKLSSQIETDSSETNSVQDEPEVSKLTPPQKNQRGLQAEGENTDSSNGVLMEVGSSSLASNTRSRRNFHPKPGLRSQEIQSTGPGTRAGTSRYGLRNLKCNSISDVMPVGCTPSDSTLNKKKDAIKKRNCEGESSSTARGKKINGPLIDGRNSVSRNGLSISDSRISRNAPHRDRADSNIASGRTRRSIGGHGRGRVSGQGNANPVAPNQSLIMVPSFSYSGNLNSPGVQHHNSLETPSSPSSYSGAGTSSEELYGVMPTSPTEYGLTHSLINRDSFRRRYNMDGIAEVLLALERIEQDVELTHEQIHLLESNLFLTGLNFFDQHRDMRLDIDNMSYEELLALEERMGTVSTAVTEEDLSECLKRSFYQSSPSDNATKCCNENKDDIKCCICQEEYVEEDEVGSLLCEHKYHVVCIQQWLRLKNWCPICKASVTPSSSPSSH

SEQ ID NO: 300 - DNA, 2330 bp, Medicago truncatula
atgatgcaagggcctagttctaacggcactgatatgaatcatcagtcttccttgaatcatgcgcaaaatgcagtagatttccggctgtcagattatagggggtcttctggtgagactgcatgtttacgtggtactggtcctaatgtgagctttaatggctggaataccggtgaacccagttctggactgaatctggtcaaccaagtcaacgatgatggtctaaaatctgaacaaaggttgtcttcgtcatgcagtgctattgctgaggatggtctaagacccgaggaaaggcaattacttgggaaccaatccagaattcatccttcctttttgcaaggttccagctccaatcatacagcccaaggtattaattttggtatggagcacattgctaactcatctgatcgcgggaaaggtaaagaaactggtagcggtgttaataacaacgatccttttggattagatagagagaagacatcaattggcagttcttcattcaaccaaacaggtgcttcatcagcaagctctgggtacatggcatggggagatagtggcagttcaagttcttctttagctaattggggtccttcctgcaaaagaaaggcccttgaagatagttctatgcaactgtgtactggaggaagctcgagttcccttgtacaatctgaaaatggttactggcttactgattctgttgatcttaatgttcctggaagcttaggtgatttgtcacctttagaggatttccgtgttactagccctccatttcagcagaatacaagaaatgaagtgagacaagaagcttccaatgcgtttccttcaatggtaagtattgcggaaaatgtggaaaggcctctacgaaactttgataggagaatgacccatctacatcatccggaatctgtacctctcaatttaacatcaacagggagtgctagacatcataattatccttctccgcatcaaatacccggctctctctcatttaacgaatccttggatttaaggttagcagctggagtaacagctgctaattctgctgtgccgcaaaaccagtcaccatccctgcacatgcatccttttccgtggaatagagctgctaatcctagagtggccagatcttcaagttcttatagctcaggagaaagagcagtacgtgatgattttaatttaagaatcttcccaagagatagtaccgagcatcccatgaacatgcctgcatcttcaggacatgaacctgcaggttggtattcatcttctagtaatttgaacaatgctggaggcatacctcctccatcctggattggatctacttcaaacgtccactcgttacctaatcctagctggacatttaaccatgaagtcccaacagaaaatctacagagagtttcagagttcagtccctggtccctttttccttcaatcagctcagcatctggtactcataatggtcattcctcctctacttccggccctccttcattttctcagggttctagtagtaatcaaccacatccaagaccatcatttatgacggaaagaaggggtggtgatgttctctctgctcctcattcattgcgaacattaccctttgacaatgaggggagacgccggctcatatctgagattcgccaagtcctgctagcaatgcggaggggtgagaacttacgagctgaggattatatgctctttgaccctttcctatatcatggcatggctgaaatgcacgacagacacagagaaatgcgccttgacgttgataatatgtcttatgaggaattgttggcattggaggagcgtataggagacgtaagcactggactgagtgaagatataattaataagttgatgaaacagcgattttacatgtctctcatgacagagtcttcttctgatctcgaaccttgctgtatctgtcaggaggaatatgttgatggacaaaatctcggtttgctagattgtgggcacgagttccacagtaactgcatcacacagtggctaatgcagaagaatctgtgcccaatttgcaaaacaacggccttggcctcgtgacgaggagaatctctccctcttcacatatcatttccatttatcagtttttatcttttgttggttctatctattactttgttttattcaatgaacttcctctcatcttagattgggaacgaaaacacacataaaaaaatagacataaagaaatattggtggttaagctctatagtagaattacatttatactgtgataatggacaattacatgtcctttatgatatctaaaagcacttgaattatattattgattttcattataagtttaagactgttga

SEQ ID NO: 301 - protein, 683 aa, Medicago truncatula
MMQGPSSNGTDMNHQSSLNHAQNAVDFRLSDYRGSSGETACLRGTGPNVSFNGWNTGEPSSGLNLVNQVNDDGLKSEQRLSSSCSAIAEDGLRPEERQLLGNQSRIHPSFLQGSSSNHTAQGINFGMEHIANSSDRGKGKETGSGVNNNDPFGLDREKTSIGSSSFNQTGASSASSGYMAWGDSGSSSSSLANWGPSCKRKALEDSSMQLCTGGSSSSLVQSENGYWLTDSVDLNVPGSLGDLSPLEDFRVTSPPFQQNTRNEVRQEASNAFPSMVSIAENVERPLRNFDRRMTHLHHPESVPLNLTSTGSARHHNYPSPHQIPGSLSFNESLDLRLAAGVTAANSAVPQNQSPSLHMHPFPWNRAANPRVARSSSSYSSGERAVRDDFNLRIFPRDSTEHPMNMPASSGHEPAGWYSSSSNLNNAGGIPPPSWIGSTSNVHSLPNPSWTFNHEVPTENLQRVSEFSPWSLFPSISSASGTHNGHSSSTSGPPSFSQGSSSNQPHPRPSFMTERRGGDVLSAPHSLRTLPFDNEGRRRLISEIRQVLLAMRRGENLRAEDYMLFDPFLYHGMAEMHDRHREMRLDVDNMSYEELLALEERIGDVSTGLSEDIINKLMKQRFYMSLMTESSSDLEPCCICQEEYVDGQNLGLLDCGHEFHSNCITQWLMQKNLCPICKTTALAS

SEQ ID NO: 302 - DNA, 1894 bp, Medicago truncatula
atggggcatagacacttattcaatgcatctccaatgtttgagggcgaggctgacccgaattggaataatatgctgactgatcaacatcatgtgaaccatggtgggaccagctcttcagaaaatggttcttttatttatcctgtggaaaatatgtctatagataacatttatttcccttctcattggaacgccaacacaaggtcaaatggatatgcatcctcaggccccaatattgaagtaccacctcctcatcaattggacacatcgggcacttctactaatgatcattttatgcattcgtctagtgctggacctttctttgcagtatctgaaaactttgtacaccagccttcttcttccaattatgacagacaagcatttcatgttgatagtggttttattgatcttacaatggggagtggacgagcgcatcacaagaggaagagccctggaattccttcagtctatgagagaggcagttcaagtgggtatttcaatgctgggacttcaagtgatcttccgatacctccagaatcatggccagagaaaccaaatatggatcctcaatatatgccttgggatcatgctgctatggcacccacattcagaggtgctggtctctcaatgaagggtgagagttctgtaaggaatgttaggagccgttcttcacttgatttggaatccaacctgtgtaggacccatttatcaagtagccattcacacaactcgtatcctactgtcccaccagtcagccattctagcttggcggatctttctcaggtttccacctctctgacaagggattggagccaaatgaacgtaactcctgctaatggaagagtgttattaccagatgctagtacttttggtcttgagacaagtcacttccctgttggaaatgctgctgctgctgccgctgctagtaatgctactgtagatgttggaagcttccatcatgattttggcacaagcagaaaccctactactgctcaaagttttcaaaatttaactcagactgctaggggaactcgaagtaattactctcagagatccactccagcttatagggcttcttcaagcttgcgcttgggtcaagcgacaccttcagataatgggttgcccatggtagctgaaggttacccttctagacatccaaggccattgaacactgttggctggcggaacagtgacagaaatggaaggtcaagaatttctagtgaaagatatagatcactggctgatcaggctgctctccatgcaagattatcatcctctgaggtaccgggttttatgattgttgagcgtgcctcactatatggttctaggaatgtgcttgatcagcacagagaaatgaggatggacattgataacatgagctatgaggaactacttgcacttggggagaggattggccaagtgaacacaggattgtctgaggatgttctttccaagtgtgtgacagaaacaatatattgttcatctgaccaatgtcaggatgaaggaagctgtgtgatctgtctggaagagtacaagaacatggacgatgttgggacacttaaaacttgtggacatgactaccatgtaagctgcatcaaaaagtggttatctatgaagaaactatgtcctatctgcaaatcttctgctttgcctgaggataagaaggataaataatttatactatagtatttatagtatttattgatctcatttgtacatatatttggacgtccttcaaattgaggaaacagactggcttttggaaatggtgtaacaagaatgctactgcatgtcaatgtatttgtttggcttcgatcttaatttagtgaagcctagaaatcattgtgaatttgaaacggatctggtttgcttctatttttaataacaaaagaaacta

SEQ ID NO: 303 - protein, 556 aa, Medicago truncatula
MGHRHLFNASPMFEGEADPNWNNMLTDQHHVNHGGTSSSENGSFIYPVENMSIDNIYFPSHWNANTRSNGYASSGPNIEVPPPHQLDTSGTSTNDHFMHSSSAGPFFAVSENFVHQPSSSNYDRQAFHVDSGFIDLTMGSGRAHHKRKSPGIPSVYERGSSSGYFNAGTSSDLPIPPESWPEKPNMDPQYMPWDHAAMAPTFRGAGLSMKGESSVRNVRSRSSLDLESNLCRTHLSSSHSHNSYPTVPPVSHSSLADLSQVSTSLTRDWSQMNVTPANGRVLLPDASTFGLETSHFPVGNAAAAAAASNATVDVGSFHHDFGTSRNPTTAQSFQNLTQTARGTRSNYSQRSTPAYRASSSLRLGQATPSDNGLPMVAEGYPSRHPRPLNTVGWRNSDRNGRSRISSERYRSLADQAALHARLSSSEVPGFMIVERASLYGSRNVLDQHREMRMDIDNMSYEELLALGERIGQVNTGLSEDVLSKCVTETIYCSSDQCQDEGSCVICLEEYKNMDDVGTLKTCGHDYHVSCIKKWLSMKKLCPICKSSALPEDKKDK

SEQ ID NO: 304 - DNA, 2433 bp, Medicago truncatula
atgcaagggcagagaggcacaattggttcctcatctgaaaccttcgagtttgattgtggatctacatcaagtactgctgctgttgatcagcacattttttggaataatatgcacactcctgccgaaaatcggatacccgagtttatgctttccccaagtgagatgaacccgcctcacgggaattctctaaaccatgaatggcagaacttgagcggatggagcttaggagaaccaagttccagtaatacacagaacgaagttaacaacaatgagctgaaaagggagttagggttatcacctccgataaatggtggtgctatagctggtccaagactagaagaaaggcactttgaaccaactagtgcattttcattggataacgtcaatacaggtcctatgtatatgtgcagccccaattctcatttggtaccacaaaatctcaatttaaatgccagtttaacagataatggcatcgataatagctatcatgtggaagttgaacatcccaacatgcacaaatccagtggtcctctaaatgagcatattccacctccgattacttctggttcttttttgcttccttctggtggaagtaacagcatttatctcggggataccgatggtcggccaggttgttctctagacacccgccgtgtatcttgtaaacgaaaggcagttgaaggaaatggtggacaatcttcagacggtggaagttctagctatagccagcatacagttggcagtgcttggaatactcttcctactcaggattatgcagggagcaattttaaccaatctgcaccggcagaacaggtgaatgcaagacttggcctgagtgtcggggacggatcttctgaaaccatacctgggtcaactgttgcaggaagctcggaaagcttccacagaaattttcgtttgaggataaatccttcaagccaacaaatttctcttcctccagccacattctcacatgggagtgtgatcagaaactctagtgttccttcatctgctccaatgttgcaaaggtaccaccctatcaataatcctctggacttgaggtcagtacaaccagtaaatgtgatgcatcctcaaagcgaacctcttctggttcatgttcctgcgttaccgaggagtgcgcaatccatcaggtggagtggtggttctagctcaacaaacaaccattcgtcaaattcagttttaggcttagatagggatactcaaccacatgaggaagcaggctcaagagctatggctagaaacattttagatcacccagtgtttgtacctgcaaatgtaagaaatgcggctcgaaatccagctaggtcttcgagcagtgcaaacttaagtattccaggaaatgttgcttcgtcatcaagaactgcaccaaatcctccagctttgaatccatcatctgtctcggcgtgggtttctcgtcctaatcctcagcagtatcctcgcaggttatctgaatatgtccgtcggtccttgttttctcccggttctgaaggtggaagttcaagcaataactatccttccttgcgtggtccttccacttcgtcagaatcaagaaatctgccatctgggaccaaccctggatcatctccatggatggagaggtcagctgatagtgaatttggaattccctattccttacgatcgttggctgctgctggtgaaggaagtagtagacttgtatccgagctccgcaatgtgttgggcatcatgcgtaggggtgggaacctgcggtttgaggatgttatgattctcgaccattcaatgtttgctgggattgctgatatgcatgataggcacagggatatgcggcttgatgttgataacatgtcttacgaggagttattggctctggaagaacgcattggaaatgtcagcacaggattgaatgaggagaccattatgaaacatttgaaacagaagaaatactcagttgatggattgggttcacagagtgagacagaaccctgctgtgtttgtcaggaggagtttaaaaatgaagatgatattggatcattggattgcgggcatgattatcacatcgactgtattaaacagtggctaacccataagaatatctgtccaatttgtaagacaacaggcttggcaacatgaggcttgtgactcatatattctattctatcttattataagataagatgaacacatagaggtcaagaaaactggcacaattagtcaggaaaattctgcttaattgaagttgaagtttctggtgcctttgttacttattaaatggccgttaagatttagccaaattttctttattatcattttttgttttatttggggaaaccaattatctcccggttaaggtgaaacatgagatgattggtgttggatgaaggaatatttctaaactctagctgataaagattgttttacatttggggaaatttctat

SEQ ID NO: 305 - protein, 708 aa, Medicago truncatula
MQGQRGTIGSSSETFEFDCGSTSSTAAVDQHIFWNNMHTPAENRIPEFMLSPSEMNPPHGNSLNHEWQNLSGWSLGEPSSSNTQNEVNNNELKRELGLSPPINGGAIAGPRLEERHFEPTSAFSLDNVNTGPMYMCSPNSHLVPQNLNLNASLTDNGIDNSYHVEVEHPNMHKSSGPLNEHIPPPITSGSFLLPSGGSNSIYLGDTDGRPGCSLDTRRVSCKRKAVEGNGGQSSDGGSSSYSQHTVGSAWNTLPTQDYAGSNFNQSAPAEQVNARLGLSVGDGSSETIPGSTVAGSSESFHRNFRLRINPSSQQISLPPATFSHGSVIRNSSVPSSAPMLQRYHPINNPLDLRSVQPVNVMHPQSEPLLVHVPALPRSAQSIRWSGGSSSTNNHSSNSVLGLDRDTQPHEEAGSRAMARNILDHPVFVPANVRNAARNPARSSSSANLSIPGNVASSSRTAPNPPALNPSSVSAWVSRPNPQQYPRRLSEYVRRSLFSPGSEGGSSSNNYPSLRGPSTSSESRNLPSGTNPGSSPWMERSADSEFGIPYSLRSLAAAGEGSSRLVSELRNVLGIMRRGGNLRFEDVMILDHSMFAGIADMHDRHRDMRLDVDNMSYEELLALEERIGNVSTGLNEETIMKHLKQKKYSVDGLGSQSETEPCCVCQEEFKNEDDIGSLDCGHDYHIDCIKQWLTHKNICPICKTTGLAT

SEQ ID NO: 306 - protein, 52 aa, Artificial sequence
  RING domain
CERKCSICQEEYSDGEEVGKMVCKHYYHFSCIKNWLRQKNWCPICKSVALNT

SEQ ID NO: 307 - protein, 52 aa, Artificial sequence
  RING domain
DDIKCSICQEEYIEGEEVGRLGCEHQYHVCCIHQWLRQKNWCPICKASAEPS

SEQ ID NO: 308 - protein, 51 aa, Artificial sequence
  RING domain
VEPCCICQEEYAEGEDMGRLDCGHDFHTACIKQWLVIKNLCPICKKTGLGT

SEQ ID NO: 309 - protein, 50 aa, Artificial sequence
  RING domain
DDGKCAICLEEYKDNSLLGILKCNHDFHTDCVKKWLKEKNSCPICKSAAA

SEQ ID NO: 310 - protein, 52 aa, Artificial sequence
  RING domain
VERNCSICQEEFEANEETGRLICGHSYHVQCIKQWLSRKNTCPVCKTVVSKT

SEQ ID NO: 311 - protein, 52 aa, Artificial sequence
  RING domain
DNERCVICLEEYKHEDTLGRLKCGHGFHCNCIKKWLQVKNTCPVCKAAAADE

SEQ ID NO: 312 - protein, 52 aa, Artificial sequence
  RING domain
EKDACIICQEEYEAKELVGTLGCGHKYHAMCIKGWLMVKNLCPICKTTALPA

SEQ ID NO: 313 - protein, 51 aa, Artificial sequence
  RING domain
MEQCVICRVEFEEGESLVALPCKHSYHSECINQWLQLNKVCPMCSAEVPTS

SEQ ID NO: 314 - protein, 52 aa, Artificial sequence
  RING domain
MERKCSICQEEFETNEEMGRLDCGHSYHVYCIKQWLSQKNICPVCKTAVSKN

SEQ ID NO: 315 - protein, 52 aa, Artificial sequence
  RING domain
DPEPCCICQEEYADGDDLGRLDCGHDFHAGCIKQWLVVKNVCPICKSTALKK

SEQ ID NO: 316 - protein, 52 aa, Artificial sequence
  RING domain
DDIKCSICQEEFVKGEEVGRLRCEHQYHVCCIRQWLLQKNWCPVCKAPALPS

SEQ ID NO: 317 - protein, 52 aa, Artificial sequence
  RING domain
EFEPCCICQEDYVEGDDLGTLHCGHDFHASCISQWLVVKNLCPICKSTALKT

SEQ ID NO: 318 - protein, 52 aa, Artificial sequence
  RING domain
CDRKCSICQEEYSGGEEVGNMACKHYYHITCIQHWLRQKNWCPICKSVAAKT

SEQ ID NO: 319 - protein, 52 aa, Artificial sequence
  RING domain
LERQCTICQEEYEAEDEMGKLDCGHFYHIRCIKQWLSQKNSCPVCKSAAMSN

SEQ ID NO: 320 - protein, 52 aa, Artificial sequence
  RING domain
DAEPCCICQEEYKDGEDLGKLDCGHDFHADCVKQWLMQKNLCPICKTTGLNT

SEQ ID NO: 321 - protein, 52 aa, Artificial sequence
  RING domain
DDIKCSICQEEYVIGDEIGNLGCEHGYHMECIKQWFKLKNWCPICKAAVESS

SEQ ID NO: 322 - protein, 52 aa, Artificial sequence
  RING domain
DAEPCCVCQEDYGDGNDIGTLDCGHDFHSSCIKQWLMQKNLCPICKTTGLAT

SEQ ID NO: 323 - protein, 52 aa, Artificial sequence
  RING domain
DAEPCCVCQEDYGDGNDIGTLDCGHDFHSSCIKQWLMHKNLCPICKTTGLAT

SEQ ID NO: 324 - protein, 52 aa, Artificial sequence
  RING domain
RCRPCCICQEEYKDGDDLGTLDCTHDFHYGCIKQWLQQKNLCPTCKSTGFAS

SEQ ID NO: 325 - protein, 52 aa, Artificial sequence
  RING domain
EGSCVICLEEYKNMDDVGTLKTCGHDYHVNCIKKWLSMKKLCPICKASVMPE

SEQ ID NO: 326 - protein, 52 aa, Artificial sequence
  RING domain
EDAKCSICQEEYTIGDEVGRLHCEHTYHVKCVQEWLRIKSWCPICKATAETS

SEQ ID NO: 327 - protein, 52 aa, Artificial sequence
  RING domain
ETEPCTICQESFKNEEKIATLDCGHEYHAECLEKWLIVKNVCPICKSEALVM

SEQ ID NO: 328 - protein, 52 aa, Artificial sequence
  RING domain
QRKCAICLEEYKEKEELGEVKGCGHDYHGRCIKKWLSMKNSCPICKSPALPD

SEQ ID NO: 329 - protein, 52 aa, Artificial sequence
  RING domain
DDVKCSICQEEYVDGDEVGTLPCQHKYHVSCAQQWLRMKNWCPICKTSAESQ

SEQ ID NO: 330 - protein, 52 aa, Artificial sequence
  RING domain
DAEPCCVCQEEYTEGEDMGTLECGHEFHSQCIKEWLKQKNLCPICKTTGLNT

SEQ ID NO: 331 - protein, 52 aa, Artificial sequence
  RING domain
DMEPCCVCQEEYAEGDDLGTLGCGHEFHTACVKQWLMLKNLCPICKTVALST

SEQ ID NO: 332 - protein, 52 aa, Artificial sequence
  RING domain
EVEPCCVCQEEYKEEEEIGRLECGHDFHSQCIKEWLKQKNLCPICKTTGLNT

SEQ ID NO: 333 - protein, 52 aa, Artificial sequence
  RING domain
NIEPCCICQEEYVEGDNLGTLKCGHEFHKDCIKQWVMIKNLCPICKTEALKT

SEQ ID NO: 334 - protein, 52 aa, Artificial sequence
  RING domain
VDRKCSICQDEYEREDEVGELNCGHSFHVHCVKQWLSRKNACPVCKKAAYGK

SEQ ID NO: 335 - protein, 52 aa, Artificial sequence
  RING domain
DDIKCSICQEEYVDGDELGTIPCQHMYHVSCVQQWLRMKNWCPICKTSAEEE

SEQ ID NO: 336 - protein, 52 aa, Artificial sequence
  RING domain
ETDSCTICQENYKNEDKIATLDCMHKYHAECLKKWLVIKNVCPICKSEALVI

SEQ ID NO: 337 - protein, 52 aa, Artificial sequence
  RING domain
ADRKCIICQDEYEAKDEVGELRCGHRFHIDCVNQWLVRKNSCPVCKTMAYNK

SEQ ID NO: 338 - protein, 52 aa, Artificial sequence
  RING domain
DDIKCSICQEEYVVGDEVGRLQCEHGYHMSCIHQWLSLKNWCPICKASVAPS

SEQ ID NO: 339 - protein, 52 aa, Artificial sequence
  RING domain
EAEPCCICQEEYNDGEDLGTLDCGHDFHAGCVKQWLMHKNWCPICKTTGLAT

SEQ ID NO: 340 - protein, 52 aa, Artificial sequence
  RING domain
DLEPCCICQEEYVDGDDMGIIDCGHDFHTNCIKQWLMQKNLCPICKMTALLT

SEQ ID NO: 341 - protein, 52 aa, Artificial sequence; identical to SEQ ID NO: 340
  RING domain

SEQ ID NO: 342 - protein, 52 aa, Artificial sequence
  RING domain
DLEPCCICQEEYVDGDDMGIIDCGHDFHANCIKQWLMQKNLCPICKMTALIT

SEQ ID NO: 343 - protein, 52 aa, Artificial sequence
  RING domain
LEKKCSICQDDYEEDGEVGKLDCGHGFHIQCIKQWLGQKNTCPVCKTEPVGR

SEQ ID NO: 344 - protein, 52 aa, Artificial sequence
  RING domain
ETSCAICLEEYKSMDKVGMIRNCGHVYHVDCIKKWLSMKNMCPICKAPAVAD

SEQ ID NO: 345 - protein, 52 aa, Artificial sequence
  RING domain
EADSCIICQDDYKSKEKIAALDCGHEYHAVCLKKWLRLKNVCPICKSEALNT

SEQ ID NO: 346 - protein, 52 aa, Artificial sequence
  RING domain
EADSCIICQDDYKSKEKIASLDCGHEYHADCLKKWLRLKNVCPICKSEALTM

SEQ ID NO: 347 - protein, 50 aa, Artificial sequence
  RING domain
DRCVICQMEYEEDESLVALSCDHPYHPECIANWLQINKICPICTTEVSSP

SEQ ID NO: 348 - protein, 52 aa, Artificial sequence
  RING domain
DDIKCCICQEEYVEEDEVGSLLCEHKYHVVCIQQWLRLKNWCPICKASVTPS

SEQ ID NO: 349 - protein, 52 aa, Artificial sequence
  RING domain
DLEPCCICQEEYVDGQNLGLLDCGHEFHSNCITQWLMQKNLCPICKTTALAS

SEQ ID NO: 350 - protein, 52 aa, Artificial sequence
  RING domain
EGSCVICLEEYKNMDDVGTLKTCGHDYHVSCIKKWLSMKKLCPICKSSALPE

SEQ ID NO: 351 - protein, 52 aa, Artificial sequence
  RING domain
ETEPCCVCQEEFKNEDDIGSLDCGHDYHIDCIKQWLTHKNICPICKTTGLAT

SEQ ID NO: 352 - protein, 44 aa, Artificial sequence
  DAR1 domain
FNDRYRGMRMDIDGMSYEELLALGDRIGTVSTGLSEDALSKCLD

SEQ ID NO: 353 - protein, 44 aa, Artificial sequence; identical to SEQ ID NO: 352
  DAR1 domain

SEQ ID NO: 354 - protein, 44 aa, Artificial sequence
  DAR1 domain
SHDQHSDMRMDIDNMSYEELLALGDRIGSVSTALSEEQFVKCLR

SEQ ID NO: 355 - protein, 44 aa, Artificial sequence
  DAR1 domain
LIDRHRDMRLDVDNMSYEELLALGERIGYVNTGLSEDKIRTGLK

SEQ ID NO: 356 - protein, 44 aa, Artificial sequence
  DAR1 domain
AQDPHRAMRLDIDNMSYEDLLALGESIGNVCTGLVDEKISGCVR

SEQ ID NO: 357 - protein, 44 aa, Artificial sequence
  DAR1 domain
MHDQHQDWRLDVDNMTYEELLDLEDRIGYVSTGLHDDEIARSLR

SEQ ID NO: 358 - protein, 44 aa, Artificial sequence
  DAR1 domain
AFDPHWDMRLDIDDMSYEELLALEERIGHVNTGLADEKISGCVM

SEQ ID NO: 359 - protein, 44 aa, Artificial sequence
  DAR1 domain
VIDEHRDMRLDVDSMTYEELVALEERIGNVNSGFTESYIEENLK

SEQ ID NO: 360 - protein, 44 aa, Artificial sequence
  DAR1 domain
DDPQDAWEDVDPDEYSYEELVALGEVVGTESRGLSADTLASLPS

SEQ ID NO: 361 - protein, 44 aa, Artificial sequence
  DAR1 domain
MYDRYQDWRLDVDNMTYEELLELGDKIGYVNTGLRDDEITRNLR

SEQ ID NO: 362 - protein, 44 aa, Artificial sequence
  DAR1 domain
IHDRHRDMRLDIDNMSYEELLALEERIGNVGTGLSEEAVIRLLK

SEQ ID NO: 363 - protein, 44 aa, Artificial sequence
  DAR1 domain
SHDHHSDMRMDIDNMSYEELLALEERIGFVSTALSEEQFAKCIR

SEQ ID NO: 364 - protein, 44 aa, Artificial sequence
  DAR1 domain
IHDRHRDMRLDIDNMSYEELLALEERIGNVSTGLTENDVMKLLK

SEQ ID NO: 365 - protein, 44 aa, Artificial sequence
  DAR1 domain
LSDRHRAMRMDIDGMSYEELLALGDRIGTVNTGLSEDALYKCLK

SEQ ID NO: 366 - protein, 44 aa, Artificial sequence
  DAR1 domain
GLDRYRNWRLDVDNMSYEELLELGDRIGYVNTGLREDEIARCVR

SEQ ID NO: 367 - protein, 44 aa, Artificial sequence
  DAR1 domain
IQDRHRDMRLDVDNMSYEELLALEERIGNVCTGLTEETILNRLK

SEQ ID NO: 368 - protein, 44 aa, Artificial sequence
  DAR1 domain
FYDQHRDMRLDIDDMSYEELLALEERIGSVSTALPEEELLKCLR

SEQ ID NO: 369 - protein, 44 aa, Artificial sequence
  DAR1 domain
VHDRHGDMRLDVDNMSYEELLALEERIGNVSTGLSEETLSKLLK

SEQ ID NO: 370 - protein, 44 aa, Artificial sequence
  DAR1 domain
VHDRHRDMRLDVDNMSYEELLALEERIGNVSTGLSEETLSKLLK

SEQ ID NO: 371 - protein, 44 aa, Artificial sequence
  DAR1 domain
IHDRHRDMRLDIDNMSYEELLALEERIGNVNTGLTEETILKHIR

SEQ ID NO: 372 - protein, 44 aa, Artificial sequence
  DAR1 domain
MLDQHRDMRMDIDNMSYEELLALGERIGHVNTGLSEDSFSQCMT

SEQ ID NO: 373 - protein, 44 aa, Artificial sequence
  DAR1 domain
FHDQHRDMRLDIDNMSYEELLALEERIGTVSTALTEEAISKCLK

SEQ ID NO: 374 - protein, 44 aa, Artificial sequence
  DAR1 domain
HIDHHRDMRLDIEEMSYEELLALSERIGTVNTGLPEEDVKNHLK

SEQ ID NO: 375 - protein, 44 aa, Artificial sequence
  DAR1 domain
MLDHHRDMRLDIDNMSYEELLDLGERIGSVNTGLSDSAISSCLL

SEQ ID NO: 376 - protein, 44 aa, Artificial sequence
  DAR1 domain
FHDQHRDMRLDIDNMSYEELLALEEKMGTVSTALSEEALLKSLK

SEQ ID NO: 377 - protein, 44 aa, Artificial sequence
  DAR1 domain
GHDRYRDMRLDVDNMSYEELLALEERIGDVCTGVNEETISNRLK

SEQ ID NO: 378 - protein, 44 aa, Artificial sequence
  DAR1 domain
MHDRHRDMRLDVDNMSYEELLALGERIGDVSTGLSEEVILKVMK

SEQ ID NO: 379 - protein, 44 aa, Artificial sequence
  DAR1 domain
IHDRYRDMRLDVDNMTYEELLSLEERIGDVCTGLNEETISNRLK

SEQ ID NO: 380 - protein, 44 aa, Artificial sequence
  DAR1 domain
MHDRHREMRLDVDNMSYEELLALGERIGDVSTGLSEEVILKAMK

SEQ ID NO: 381 - protein, 44 aa, Artificial sequence
  DAR1 domain
SRDNYHELRLDVDSMSYEQLLELGDRIGYVNTGLKESEIHRCLG

SEQ ID NO: 382 - protein, 44 aa, Artificial sequence
  DAR1 domain
FYDQHRDMRLDIDNMSYEELLALGDKMGTVSTALSEEALSRSLK

SEQ ID NO: 383 - protein, 44 aa, Artificial sequence
  DAR1 domain
YVDHHQDMRLDIEDMSYEELLALSDQIGTVKTGLSSEDVKELLK

SEQ ID NO: 384 - protein, 44 aa, Artificial sequence
  DAR1 domain
SFDQFRDMRLNVDNMTYEQLLELGERIGHVNTGLTEKQIKSCLR

SEQ ID NO: 385 - protein, 44 aa, Artificial sequence
  DAR1 domain
FHDQHRDMRLDIDNMSYEELLALEERMGTVSTALTEEALSECLK

SEQ ID NO: 386 - protein, 44 aa, Artificial sequence
  DAR1 domain
MYDRHRDMRLDVDNMSYEELLALEERIGNVSTGLSEETIVNNLK

SEQ ID NO: 387 - protein, 44 aa, Artificial sequence
  DAR1 domain
MHDRHRDMRLDVDNMSYEELLALEERIGDVSTGLSEETILKLLK

SEQ ID NO: 388 - protein, 44 aa, Artificial sequence; identical to SEQ ID NO: 387
  DAR1 domain

SEQ ID NO: 389 - protein, 44 aa, Artificial sequence
  DAR1 domain
MHDQHRDMRLDVDNMSYEELLALEERIGDVSTGLSGETILKLMK

SEQ ID NO: 390 - protein, 44 aa, Artificial sequence
  DAR1 domain
RMDRFSNWRLDIDHMTYEQLLDLGDRIGYVNTGLKEDEISRCVK

SEQ ID NO: 391 - protein, 44 aa, Artificial sequence
  DAR1 domain
FLDQYRDMRLDVDSMSYEELLALGERIGIVNTGLPEDVFSKCLV

SEQ ID NO: 392 - protein, 44 aa, Artificial sequence
  DAR1 domain
HVDHHRDMRLDIEDMSYEELLALGERIGNVNTGLSEGTIRSQLK

SEQ ID NO: 393 - protein, 44 aa, Artificial sequence
  DAR1 domain
YADHHRDMRLDIEDMSYEELLALGERIGNVNTGLSDATIRSQLK

SEQ ID NO: 394 - protein, 44 aa, Artificial sequence
  DAR1 domain
SDEDMEEDEVDPDELSYEDLIALGEFVGQEKRGLSRNEISTCLR

SEQ ID NO: 395 - protein, 44 aa, Artificial sequence
  DAR1 domain
FFDQHRDMRLDIDNMSYEELLALEERMGTVSTAVTEEDLSECLK

SEQ ID NO: 396 - protein, 44 aa, Artificial sequence
  DAR1 domain
MHDRHREMRLDVDNMSYEELLALEERIGDVSTGLSEDIINKLMK

SEQ ID NO: 397 - protein, 44 aa, Artificial sequence
  DAR1 domain
VLDQHREMRMDIDNMSYEELLALGERIGQVNTGLSEDVLSKCVT

SEQ ID NO: 398 - protein, 44 aa, Artificial sequence
  DAR1 domain
MHDRHRDMRLDVDNMSYEELLALEERIGNVSTGLNEETIMKHLK

SEQ ID NO: 399 - protein, 7 aa, Artificial sequence
  DAR1 domain motif 8
  VARIANT (3)..(3): Xaa is Glu or Gln
  VARIANT (5)..(5): Xaa is Ile or Leu
  UNSURE (6)..(6): Xaa can be any naturally occurring amino acid
YEXLXXL

SEQ ID NO: 400 - protein, 107 aa, Artificial sequence
  RING domain consensus sequence
  UNSURE (2)..(3): Xaa can be any naturally occurring amino acid
  UNSURE (5)..(13): Xaa can be any naturally occurring amino acid
  UNSURE (14)..(43): Xaa can be any naturally occurring amino acid
  UNSURE (45)..(45): Xaa can be any naturally occurring amino acid
  UNSURE (46)..(47): Xaa can be any naturally occurring amino acid
  UNSURE (49)..(50): Xaa can be any naturally occurring amino acid
  UNSURE (51)..(51): Xaa can be any naturally occurring amino acid
  UNSURE (53)..(54): Xaa can be any naturally occurring amino acid
  UNSURE (56)..(59): Xaa can be any naturally occurring amino acid
  UNSURE (60)..(103): Xaa can be any naturally occurring amino acid
  UNSURE (105)..(106): Xaa can be any naturally occurring amino acid
  Positions (14)..(43), (46)..(47), (51), and (60)-(103) can also be a gap
CXXCXXXXXXXXXXXXXXXXXXXXXXXXXXXXXXXXXXXXXXXCXXXHXXXHXXCXXXXXXXXXXXXXXXXXXXXXXXXXXXXXXXXXXXXXXXXXXXXXXXXCXXC

SEQ ID NO: 401 - protein, 40 aa, Artificial sequence
  RING domain ARKL proteins consensus sequence
  UNSURE (2)..(2): Xaa can be any naturally occurring amino acid
  VARIANT (3)..(3): Xaa is Val or Ile
  VARIANT (5)..(5): Xaa is Leu or Gln
  VARIANT (8)..(8): Xaa is Phe or Tyr
  UNSURE (9)..(14): Xaa can be any naturally occurring amino acid
  VARIANT (15)..(15): Xaa is Val or Gly
  UNSURE (16)..(18): Xaa can be any naturally occurring amino acid
  UNSURE (20)..(20): Xaa can be any naturally occurring amino acid
  UNSURE (22)..(23): Xaa can be any naturally occurring amino acid
  UNSURE (25)..(26): Xaa can be any naturally occurring amino acid
  UNSURE (28)..(29): Xaa can be any naturally occurring amino acid
  UNSURE (32)..(36): Xaa can be any naturally occurring amino acid
  UNSURE (38)..(39): Xaa can be any naturally occurring amino acid
CXXCXEEXXXXXXXXXXXCXHXXHXXCXXWLXXXXXCXXC

SEQ ID NO: 402 - protein, 47 aa, Artificial sequence
  RING domain of ARK protein of Mus musculus
DTEEKCTICLSILEEGEDVRRLPCMHLFHQVCVDQWLITNKKCPICR

SEQ ID NO: 403 - protein, 46 aa, Artificial sequence
  RING domain of Goliath protein of Mus musculus
RTGEINIAVTKEWFIIASFGLLSALTLCYMIIRATASLNANEVEWF

SEQ ID NO: 404 - DNA, 56 bp, Artificial sequence
  primer 1
ggggacaagtttgtacaaaaaagcaggcttaaacaatggatgatcacatgggaaga

SEQ ID NO: 405 - DNA, 50 bp, Artificial sequence
  primer 2
ggggaccactttgtacaagaaagctgggttttggtttctgaagaagcacc

SEQ ID NO: 406 - DNA, 2193 bp, Oryza sativa; identical to SEQ ID NO: 172

SEQ ID NO: 407 - DNA, 3350 bp, Artificial sequence
  expression cassette comprising the GOS2 promoter, the nucleic acid encoding the Orysa_ARKL1  polypeptide and the T-zein + T-rubisco transcription terminator sequence
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttcatttaaatcaactagggatatcacaagtttgtacaaaaaagcaggcttaaacaatggatgatcacatgggaagacggacagttggtggccttctcttcaccaaggggggctcaattcttctcttcagagaagacagtgcgcgtcacaaggccaccaattgctgcacgcgacacggttgcagcagcaagcatttggccggcaaagacaagcaaacacacagggcagcaacagcagccaaggaagcatcagaaacccctcggagatcacagattttcaggaaacccagcacgaggactcctcagggaagtactgctactgataacatcagcaggaatgcagcaagctcctatagcgaaaacgacaataggccaagagaaactccagggcgtgatttaatcgctcgtctcaaagagagggtcaatgcatcaagaaaacgatcattgaacagagaaaacagtccatcatcaccaaatggattaagtgctacttcctcaagtagtagccgcacagtctcaagaccgtcgcatcgggcagcttcccgaataaggaaggcagatgaaggtgcaaatgcaggagctgtaaatgtacgcagagacagcagtggagataccaggaggaattcagatagggatgtcgatgatttcttgctagttgagcaggcagcaagagatagcactgaaggattcatatctggattcttggcaagatacagaagtaatcatcagggactactttcatctttggacgacagcatagaggatgcaaatgggtactggcgcttcaatatggaaggaagtgaagagcttgagaactacttcatattcaatgatcggtacagagggatgagaatggacattgacggcatgtcttatgaggaattgctagcattgggagatagaattggcaccgtaagcactggcctttcagaagacgcgctgtccaagtgtctagacagaagcatgtacatggccactacttcaggaactcatgaagattgtgagagaaaatgcagcatatgccaggaggaatattcagatggtgaggaggtgggcaagatggtctgcaaacattactaccacttctcctgcataaagaactggctccggcagaagaactggtgtcccatttgtaaatccgtcgctctgaataccaactag

SEQ ID NO: 408 - DNA, 1287 bp, Oryza sativa
atggacaccgcgtcgttcgtgacgtcgctgctgacgtcgttcgtgatcttcgtcgtgctggtgctggtgttcacgtggctgtcgagcaggccgggcaatgcgccggtgtactacccgagcgtcctgctgcgggggctcgacccgtgggaggggcgggggcgggggacgaggagccccgtcgggtggctgcgccaggcgatctccgcctcggagggtgacgtcgtcgccgtcggcggggtcgacgccgccgtctacctcgtcttcctctcctccgtgttgtccatcttggtgttctctgggattgtgctgcttccagttctgctacctgttgctgctactgacgataacctgaacctggagagggccattggcctgaagaacggcaaaacaccccagaacttcacagagctcgagaaattagcactgggcaatgttcaagaacatagccgaaggctgtgggcatttctattatcagtctattgggtctcttttgtcacgtacttcgtactatggaagtcctacaagcatgtttctaatatgagagcggctgcaagatcaacaccagatgttaaaccggaggagtttgctgtgttggtgagagatgttcctaagccacctcctgatcaaactataaaggattctgtagactcatatttccgagcacttcatcctgataccttctacagatcaatggttgtgactgaccacacaaaggctgacaaaatttatcaagagattgaaggtcacaaacagaaaattgctcgtgctgaagttgtctatgcggagtctaaaacaacaggcaagcctgagggcaccaagcctacgcatcggattggatttcttggtcttatcggtaaaaaggttgatacaattgagtattgtaatgaccaaatcaaggagttgctgcccaaactggaggccgaacagaagactacccttcgtgagaaacagcaacaggctgcaattgtgtttttcaacagaagatctgctgcagcttctgcatctcagactctccatgctcagatgtttgataaatggactgttgagcaggctcctgaaccacgccagataatatggtctaatccttccaagaaaatatatgagaggcaaatcagacaggttgtggtctataccattgtctttctcacagtggttttctatatgattcctattactgctatctctgctcttacaactttggagaagttgagggagaagcttccctttctgaaggtggtggtggaccaaccgaaaatcaagactgtcctacaggcttacctcccgtag

SEQ ID NO: 409 - protein, 428 aa, Oryza sativa
MDTASFVTSLLTSFVIFVVLVLVFTWLSSRPGNAPVYYPSVLLRGLDPWEGRGRGTRSPVGWLRQAISASEGDVVAVGGVDAAVYLVFLSSVLSILVFSGIVLLPVLLPVAATDDNLNLERAIGLKNGKTPQNFTELEKLALGNVQEHSRRLWAFLLSVYWVSFVTYFVLWKSYKHVSNMRAAARSTPDVKPEEFAVLVRDVPKPPPDQTIKDSVDSYFRALHPDTFYRSMVVTDHTKADKIYQEIEGHKQKIARAEVVYAESKTTGKPEGTKPTHRIGFLGLIGKKVDTIEYCNDQIKELLPKLEAEQKTTLREKQQQAAIVFFNRRSAAASASQTLHAQMFDKWTVEQAPEPRQIIWSNPSKKIYERQIRQVVVYTIVFLTVVFYMIPITAISALTTLEKLREKLPFLKVVVDQPKIKTVLQAYLP

SEQ ID NO: 410 - DNA, 2307 bp, Oryza sativa
atggctactattcaagatataggtgtctctgcagctatcaacatactgagtgccatcactttcctgctagcgtttgctttcctgcgactacagcccatcaacgatagggtttacttcccaaagtggtatctcaaaggtgcaagagagagtccaagtcatgggggtgcatttgtgcggaagtttgtcaatttggacatgcgatcatacttgaaggtcttaagttggatgcctgctgctctcaaaatgccagaggatgagttaattagccatgcaggccttgattcagctgtctatctgcggatctacttaatagggcttaaaatatttgctccaatcacagttctagcatttattattcttgtgcctgttaattggaccaatattacccttcaaagctcgaaggtgcagcacagtgatattgacaaactttcaatatccaacatacctgtagggtcaaagaggttcgcagctcacctgaccatggcttatgttttcacattttggacatgctatgtgctgttacgggagtatgaaatagtggcaacaatgcgtctgcgctttcttgcatcagagaagcgccgcccagatcagttcacggtccttgtgcggaatataccgcctgatcctgatgaatcaattggtgagcttgtggaacatttcttccttgtaaaccatcctgaccattatcttacgcaccaggttgtctataatgcaaataagcttgataagatggtcaaagagaagaagaaaatgcagaattggcttgattactatcagctgaaatatgaaagaaatacatctcaaaggcctactacaaagactggttttcttggatgttttggttcaaaggtggatgctattgaatactacacatctgaaattgagaggatagaaaaggaagaaactgatgaacgtggaaagattatgaaggatccaaaatcagttgtgccagcagcctttgtttccttccgatcgcggtggggagcagcagtgtgtgctcagacacagcaaaccagtaatccaactgtctggttgaccgagtgggccccagaacctcgtgatgtctattgggataacctctctattccttttgtttacctgacaattaggaggctgataattgcggttgcattcttcttcctgaacttcttttatgtgctcccgattgcatttgttcagtcccttgcaaatattgaagggattgagaaggcagctccatttctgaagcctttgattgaaatgcgtactattaaatcattcatccaaggatttctgccaggaattgctctgaagattttccttatattgctccctagcatattaatgtttatgtctaaagttgaaggattgacatcggtgtcctcactggagaggagatctgcttttaagtactatatcttcttgttctttaatgtattcttgggaagcattattgcaggatctgctttagagcagctcaaaacatttcttcaccaatcagcaaatgaaataccaaggacaattggtgaagcaattccaatgaaagcaaccttttttataacatatgtaatggttgatggttgggctggggtagctggtgaaattttaagattgaaaccattgataatcttccacttgaaaaactttttcttggtcaagactgagaaagacagagaagaagcaatggaccctggaagcattggttttgactcaaatgagcctcaaatacagctctatttcttgctcggacttgtctatgctgtggtgacaccatttttgcttcctttcatattaatattctttgggttagcatatgtggtataccgtcaccagataataaatgtgtacaaccaagaatatgaaagtgcagcagcattttggccaagtgttcatggacgcataattgtagcattaatcgtatcacagctgcttctccttggattactaagcacaaaaggtgctggccagtcaacaccggtgctccttgttctccctgttgtaaccttttatttctataaatactgcaagaatcgctatgagcctgcttttgtggaatatccattacaggatgcaatgcggaaggataccctagaacgcgcaagagagccagggttcgacctcaaaggatacctgatgaatgcctacatccacccggtgttcaaaggcgacgaggacgacgagaagttctccatctccgacgaaccagaggcggagcaggttctcgtggcgacaaagcgccagtccagacggaacaccccagttccgagtaaatacaatggctctgaatcaccttcccttgctgaaattgtaaatgatcaacggctataa

SEQ ID NO: 411 - protein, 768 aa, Oryza sativa
MATIQDIGVSAAINILSAITFLLAFAFLRLQPINDRVYFPKWYLKGARESPSHGGAFVRKFVNLDMRSYLKVLSWMPAALKMPEDELISHAGLDSAVYLRIYLIGLKIFAPITVLAFIILVPVNWTNITLQSSKVQHSDIDKLSISNIPVGSKRFAAHLTMAYVFTFWTCYVLLREYEIVATMRLRFLASEKRRPDQFTVLVRNIPPDPDESIGELVEHFFLVNHPDHYLTHQVVYNANKLDKMVKEKKKMQNWLDYYQLKYERNTSQRPTTKTGFLGCFGSKVDAIEYYTSEIERIEKEETDERGKIMKDPKSVVPAAFVSFRSRWGAAVCAQTQQTSNPTVWLTEWAPEPRDVYWDNLSIPFVYLTIRRLIIAVAFFFLNFFYVLPIAFVQSLANIEGIEKAAPFLKPLIEMRTIKSFIQGFLPGIALKIFLILLPSILMFMSKVEGLTSVSSLERRSAFKYYIFLFFNVFLGSIIAGSALEQLKTFLHQSANEIPRTIGEAIPMKATFFITYVMVDGWAGVAGEILRLKPLIIFHLKNFFLVKTEKDREEAMDPGSIGFDSNEPQIQLYFLLGLVYAVVTPFLLPFILIFFGLAYVVYRHQIINVYNQEYESAAAFWPSVHGRIIVALIVSQLLLLGLLSTKGAGQSTPVLLVLPVVTFYFYKYCKNRYEPAFVEYPLQDAMRKDTLERAREPGFDLKGYLMNAYIHPVFKGDEDDEKFSISDEPEAEQVLVATKRQSRRNTPVPSKYNGSESPSLAEIVNDQRL

SEQ ID NO: 412 - DNA, 2106 bp, Oryza sativa
atggacgcggaggggttgctggcgtcggcggcgatcaacctgggcctggcgctggtggcgctctcgctcttctccttgctcaagaagcagcccggcaacgcgccggtgtaccttgcgcggcggatggccgccggtggcggtgggggcgggctgccgctcggccacgggcggttgaccccgtcgttccggtggatccgcgccgcgctccggctctccgaggacgacgtgctgcggcgccacggcctcgacgcgctcgtcgtcgtccgcctcttcaaattcgggatcaagtgcttcgctgtttgctcaatcgttggattgttcatccttgcaccaacaaattattcctgtgaaggtctacaagacaccaaaaggtcaaattcaatggaacttttcacggtatccaatgtggcaaggggttctaacaggctttgggtgcattttgcatgcctctgcttcatatcattctatgtggtgtatttgcttcataaggagcacaaagaaatgtccagcagaagaattgcacatttgaagtatcacaggaaacggcctgaccaatataccattttagttcgaggaattccactatgcccagatcatggaacttatgggtgttatgctgaccacttcttctcaaagcactaccgaacataccaatcgtatcacatagtacacgacattggaaacatcaaggcacttcagaagttggcatcctcccttgaggacaagataaagaggaaaagagaaaccagaagatgtaacttttggaagtggatctggtttaagttgacattagaagcgatagatactcgcaaactggaagaaaaactgaagaacgtccatcactctatccgcctcctacagtgtgaaaatatgcttaaacggaaggaattaccggttgcttttgtctcattcaaatcacagctggatgctgcccaagctgccgaaatgcaacagcatgtcaatcctctgtccttggtgacaacatatgctcctgaaccacctgatgcactatggacaaatctggctattcctttctgccgtattgctatatacaaacttggtgtcttcattgctgcgtttctgctaatagtgttcttcaccatccctgtcacagctgtgcaagggatagtacaatttgagaaaattaaaatatggtttccaccggctagagctgtggaacttataccaggtttgaattctgtcgtaactgggtatcttccaagcatgatcttgaatggctttatctacttgattcccttcgcgatgcttggcatggcatcatttgagggatgcattgcaaaaagtcagaaggaaatcaaggcctgcaacatggtattttacttcttgttagggaatgttttctttttgagcattctttctggttctctactccaccagataggagaatcctttacacatccaaaagacatacctagccgtctggcccgtgctgtttctgcacagtcagatttcttcatcacatacattttgaccgacggcatgtcagggttttccttggaggttcttcagtttggtttgcttacatggcatttcttcaaggcacattcaattggacatagtgagcagccatatctttatggcttcccttactacagagttgtgcccatcgtttcccttgcagtattgattgggttggtctatgctgttgttgcgcctcttctacttccaattcttgttatctactttttgcttggttacgcagtgtacatcaaccagatggaagatgtatatgagattacatatgatacttgtggacaatattggcccaatattcatcgctacatcttcctttcggtcacactcatgcaaattacaatgctgaagtcgaaaccgggggcttcattcgccacggttcccttgcttgtgtcaaccattttgttcaatgagtactgcaaggttcggtttcttccaactttccttcatcgaccggttcaggttgccaaggagaatgacgaccttaatgaagctgaggggatgagaggtgacctggaccatgccattagcgcctataagccaccatggatgcgcccgacgaacttctctccagattgtagttcggtacaacctttgatccgttctgtatag

SEQ ID NO: 413 - protein, 701 aa, Oryza sativa
MDAEGLLASAAINLGLALVALSLFSLLKKQPGNAPVYLARRMAAGGGGGGLPLGHGRLTPSFRWIRAALRLSEDDVLRRHGLDALVVVRLFKFGIKCFAVCSIVGLFILAPTNYSCEGLQDTKRSNSMELFTVSNVARGSNRLWVHFACLCFISFYVVYLLHKEHKEMSSRRIAHLKYHRKRPDQYTILVRGIPLCPDHGTYGCYADHFFSKHYRTYQSYHIVHDIGNIKALQKLASSLEDKIKRKRETRRCNFWKWIWFKLTLEAIDTRKLEEKLKNVHHSIRLLQCENMLKRKELPVAFVSFKSQLDAAQAAEMQQHVNPLSLVTTYAPEPPDALWTNLAIPFCRIAIYKLGVFIAAFLLIVFFTIPVTAVQGIVQFEKIKIWFPPARAVELIPGLNSVVTGYLPSMILNGFIYLIPFAMLGMASFEGCIAKSQKEIKACNMVFYFLLGNVFFLSILSGSLLHQIGESFTHPKDIPSRLARAVSAQSDFFITYILTDGMSGFSLEVLQFGLLTWHFFKAHSIGHSEQPYLYGFPYYRVVPIVSLAVLIGLVYAVVAPLLLPILVIYFLLGYAVYINQMEDVYEITYDTCGQYWPNIHRYIFLSVTLMQITMLKSKPGASFATVPLLVSTILFNEYCKVRFLPTFLHRPVQVAKENDDLNEAEGMRGDLDHAISAYKPPWMRPTNFSPDCSSVQPLIRSV

SEQ ID NO: 414 - DNA, 2379 bp, Oryza sativa
atggggccgaccgcgccgccgccggacgccggcggcggggagccggaggcgtggtacggcagcatccagtacctggtcaacatctccgcggtgggggccgcctcctgcgtgctcctcttcctcctcgtcaagctccgcttcgaccaccgccgcatcccggggccctccgcgctcgccgccaagctcctcgccgtctaccacgccaccgcgccgcagatcgcgctccactgcggggccgacgccgcccagttcctcctcttcgagcgcgcctccttcctcgtgctcgccgccgtggccgccgccgccgtcgccgccgccctcccgctcaacctcctcgccggggacgccgccatcgccgaccagttcgccgccaccaccatctcccacatccccaagtcatccccgctcctctggctccatctcctcctcaccgccgccgtcgtcgccatcgcccatctcggcatctcccgcatggaggacgcccttcgcatcacccgcttccgcgacggcaacggcaaccccagcgaccccaactccagctcggttgccgtcttcaccatcatgatccagggcattcccaagacgctcgccgcagacaagaccccgctcaaggattactttgagcacaagtaccctggaaaggtgtaccgggtcatcgtgcccttcgatctctgcacgctggagtatctagctgaggagtgggggaaggtgcggaacaggatttcttggctggaggcaaggatggatgcccgcaacctatttgatgaatttgctcagggtggaagacattcagaagagcattggattgtgaggagatgcaaagagctgtgggtgatgacagcagagaggttcgggtttactgacgaggaaatgctaaggaggttgcagacaaagaaacttgtcctcggtagcaggttatcggattataaggatgggcgtgctcccggtgctggcatagcctttgtggtttttaaggacgtgtatacagcaaacaaggctgtgagagatttccggatggaaaggaagaagacaccaatagggaggttcttcccggtgatggagctccagcttgagagaagccgttggactgtggaaagggcaccaccggcatcagatatctactggaaccatctagggctgagcaagacctcactaggattgcggcgtattgcagtcaacacctgcctcattctgatgctcttgttcttcagttcaccattggcaataattagtgggatgcaaagtgcagcgcggatcatcaatgtggaggctatggataacgccaaatcatggcttgtctggctccaaagctctagctggttctggaccattatctttcagtttcttcccaacgtcctcatttttgtgagcatgtatattatcatcccatcagtgctgtcttacttctccaagtttgagtgtcatctgacagtgtcgggagagcagagggctgcattgttgaagatggtttgcttcttccttgttaatctcattctactgcgtgcgctggtggaatcatcgcttgaaagttggatactcagtatgggccggtgctacctagacagtgttgattgcaagcagattgaacaatacttaagcccctcttttttgtcaagatcttcactctcctccctggcattcttgatcacatgcacctttctaggaatatcctttgatctgttggctccaatcccttggataaagcatgtaatgaagaaatttagaaagaatgatatggtccagttggtccctgaagaaaatgaggactaccaactgatgcatgatggcgaagaaacaaataatttgagagcgcctctaatgtctgagagagaagacagtggcattctgaatggtattgaggagcatgatctttcattgtacccgataaacaggagcttccatatgccaaagcagacatttgactttgcacaatactatgcatttgacattacaatattcgcgctcacaatgatctactcactgtttgctcctctgacagttcctgtcggcgcagtatactttggctaccgataccttgtggacaagtacaatttcctgtttatctacagagttagagggtttcctgcaggcaatgatgggaagctgatggacatggtgatctgcatcatgcaattctgcgttattttcttccttgttgcaatgttactattctttgcagtccaaggtgatcctatgaagctacaggcaatatgtactcttagtttgttagtcttttataaattgctgccctctagaagtgatcgcttccagccatccttgttggaagggatgcagacagttaatagctttgtagatggtccaacagattatgaagttttttcacaacctgacctggattggagcctgtatcaatcctga

SEQ ID NO: 415 - protein, 792 aa, Oryza sativa
MGPTAPPPDAGGGEPEAWYGSIQYLVNISAVGAASCVLLFLLVKLRFDHRRIPGPSALAAKLLAVYHATAPQIALHCGADAAQFLLFERASFLVLAAVAAAAVAAALPLNLLAGDAAIADQFAATTISHIPKSSPLLWLHLLLTAAVVAIAHLGISRMEDALRITRFRDGNGNPSDPNSSSVAVFTIMIQGIPKTLAADKTPLKDYFEHKYPGKVYRVIVPFDLCTLEYLAEEWGKVRNRISWLEARMDARNLFDEFAQGGRHSEEHWIVRRCKELWVMTAERFGFTDEEMLRRLQTKKLVLGSRLSDYKDGRAPGAGIAFVVFKDVYTANKAVRDFRMERKKTPIGRFFPVMELQLERSRWTVERAPPASDIYWNHLGLSKTSLGLRRIAVNTCLILMLLFFSSPLAIISGMQSAARIINVEAMDNAKSWLVWLQSSSWFWTIIFQFLPNVLIFVSMYIIIPSVLSYFSKFECHLTVSGEQRAALLKMVCFFLVNLILLRALVESSLESWILSMGRCYLDSVDCKQIEQYLSPSFLSRSSLSSLAFLITCTFLGISFDLLAPIPWIKHVMKKFRKNDMVQLVPEENEDYQLMHDGEETNNLRAPLMSEREDSGILNGIEEHDLSLYPINRSFHMPKQTFDFAQYYAFDITIFALTMIYSLFAPLTVPVGAVYFGYRYLVDKYNFLFIYRVRGFPAGNDGKLMDMVICIMQFCVIFFLVAMLLFFAVQGDPMKLQAICTLSLLVFYKLLPSRSDRFQPSLLEGMQTVNSFVDGPTDYEVFSQPDLDWSLYQS

SEQ ID NO: 416 - DNA, 2334 bp, Oryza sativa
atgaaagtcggcgctcttttgacctcagctggaatcaacattagcctctgtatactttttttgtcactgtattccgttctgaggaagcaaccgcaaaatgttaaggtctattttggaagaaggattgctgaggagaatagtaggctcagggaggcttttattttggagagatttgttccatccgctagctggattttgagaagtcttcgatgcacggaggatgaactcttagctactgctgggttggatgcagttgtcttcaataggattcttgtatttagcatacgcatattctccttagccgctttcctttgtgtacttggagttcttccactgaattattttggacaagatatgctccatgtacggattccttcagcatcattggagacatttacaattggaaatatgcaagagagatcaagatggctctgggtccattgtgttgcactgtacatcatatctggtgtggcttgccttcttctataccttgagtacaagcatattgctaggctgaggttacttcatgtttctcgagcatcgaccaatcctagccattttactgtgcttgttcgtggagtaccaaaatcaactaaagaatcaattagttgcactgttgagagtttcttcaccaagtatcatgtgtcgagttacctttctcatcagattatttataaagtcgggaaacttcagaagattgtgactggtgcaaagaaggcttataagaaatttaaacatttcaagggcaccacagttgatcagagatgcggaccaattacatatagatgtggtctttgtggagcttcatcaaagtcgttcgagttgctgcctgttgaacctgagcaagagatgaaaaaacatgatgtgaaagattcagagttgagcttacctgataaggattgtggtgctgcttttgtatttttcaaaactcggtatgcagccctggtcgtatcagaaattgttcagacatccaatcctatggaatgggttactagtcttgctccagatcgagatgacgtatattggtcaaatctttggttaccctacaagcagctttggattcgccgtatagttacactttcgggttctattgtttttatgttcctgtttctcatacctgtgacatttatacaaggtctaactcagttggagcagctgcagcaaaggctccctttcctaaatggcatattaaaaaagaagtacataacccagctagtgaccggataccttcccagtgtcatcttgcaaatatttttatacactgttcccccaaccatgatgtttttttctacattagaaggacccgtgtcccacagtgaaaggaagagaagtgcctgctgtaaagtattatacttcactatttggaatgtattctttgtgaatgtcctatcaggttctgcaattagccaagtgaatgcgttatcaagcccaaaggacattcctatggtgcttgctagagcggtacctgtacaggctacattctttaccacctatgtactgacttctggttgggctagtttatcatcagaacttatgcaactctttggtctcacatggaactttataatgaagtatgttttgagaatgaaagaggatagctactttgtcccgtcatttccctatcatactgaagtgccaaaagttctgttgtttggactactgggattcacatgctctgtattagcacctctcatcttgccctttttactggtgtacttttttcttggttatgttgtgtaccgcaaccagttcctcaatgtttattgcacgaaatacgacacaggtggtctgtattggccgattgctcactatacaacaatcttctctattgtgctcacccagatcatctgtcttggtgtctttgggcttaaagaatccccagtagctgcaggcttcactgtacctctcatcatcctcactcttttattcaaccagtattgcagcaatcgtcttcggccattattcaagactctccctgcacaggatttaattgacatggacagggaggacgagcaatcgggaagaatggatgacattcaccaccgtcttcattctgcttactgccagtttgctgacactgacgacatacctctgaaaggagttcacgttgacagagatgcagatgcaagcggaagttccggtgaatctagctgcaaagaagacaccaaccaacccacaaccagtgacatttctcaccctacactggaaggactccctgtaaaccggctacggcatgcagtgaggtcgctcagttccatcatcaggttacagaagagaggcctgtcaccacagcccgctggaccctccgccgatgtaaatccgcaaactgcataa

SEQ ID NO: 417 - protein, 777 aa, Oryza sativa
MKVGALLTSAGINISLCILFLSLYSVLRKQPQNVKVYFGRRIAEENSRLREAFILERFVPSASWILRSLRCTEDELLATAGLDAVVFNRILVFSIRIFSLAAFLCVLGVLPLNYFGQDMLHVRIPSASLETFTIGNMQERSRWLWVHCVALYIISGVACLLLYLEYKHIARLRLLHVSRASTNPSHFTVLVRGVPKSTKESISCTVESFFTKYHVSSYLSHQIIYKVGKLQKIVTGAKKAYKKFKHFKGTTVDQRCGPITYRCGLCGASSKSFELLPVEPEQEMKKHDVKDSELSLPDKDCGAAFVFFKTRYAALVVSEIVQTSNPMEWVTSLAPDRDDVYWSNLWLPYKQLWIRRIVTLSGSIVFMFLFLIPVTFIQGLTQLEQLQQRLPFLNGILKKKYITQLVTGYLPSVILQIFLYTVPPTMMFFSTLEGPVSHSERKRSACCKVLYFTIWNVFFVNVLSGSAISQVNALSSPKDIPMVLARAVPVQATFFTTYVLTSGWASLSSELMQLFGLTWNFIMKYVLRMKEDSYFVPSFPYHTEVPKVLLFGLLGFTCSVLAPLILPFLLVYFFLGYVVYRNQFLNVYCTKYDTGGLYWPIAHYTTIFSIVLTQIICLGVFGLKESPVAAGFTVPLIILTLLFNQYCSNRLRPLFKTLPAQDLIDMDREDEQSGRMDDIHHRLHSAYCQFADTDDIPLKGVHVDRDADASGSSGESSCKEDTNQPTTSDISHPTLEGLPVNRLRHAVRSLSSIIRLQKRGLSPQPAGPSADVNPQTA

SEQ ID NO: 418 - DNA, 2232 bp, Oryza sativa
atggaattttctgcccttctgacttcggcaggcataaacatcggcctctgtgcgctcttcctgtcactctattcagtccttaggaagcagcctcacaactatggcgtctacttcgggaggcggctcgccgaggagaagttccggcagcaggtcgactacttctcgcttgagaggctcttgcctaccgctggatggatagtgaaagcgtactggtgcacggaagaggagatacgacgggttgctggcttggattccgtggtgttcctccgcctcttcatcttcagcatacgtatcttctcgataacttctcttgtttgcatatttggagtgcttcctgttaattaccatgggaaagaaacgaatcacggacgtattccagcagagtctctcaatgtattcacaattgcaaatctcaaagaaggatcacgaatgctttgggtgcattgtgttgccttatatgttataacaatatcagcttgtattcttctatactatgagtataagtatatatcaaggaagagattggcgcatattactggatcaccacctggtccgggtcatttttctgtgattgttcgatcaataccaaagtcagataatgagctacttgatgacactatcagaaatttctttgttaattatcatggatccagttacttgtcacatcagatgatctaccggaaaggaagtatgcagaaatttgtggataatgcagagagggtatataggaaatttgtaagagttaagatgtcttcatttggacagagtagaaggtctgacttgtccagatgtggtctttgtggagtacgggcttcgtcgtttcagcaatatcgcaataaattcatcaattccaagaagccagacctaagtgatccagaagtaattgaagctcagaaggattgtccaggtgctatagtattcttcaagactcgctatgcggcaattgttgcttcacgaattcttcaatcttcaaatcctatgctatgggtgacagattttgctcctgagccaagggatgtctattggtcaaacctctggatcccctatagacagatctggctccggaaaatagcaacacttgcagctagtgttgccttcatgtttgtttttattgtccccgttgcattcgtccaaagcatgatgcaactggatcagattgagcagctatttccaagcctgaaaaacatgttgaagaagcccttttttgtcaaacttgtaacgggatacctccctagcgtcgttctgctgctgtccctgtacacagttcctccattgatgatgttcttctcttccatagaaggatcgatttctcgcagtggcaggaaaaaaagtgcttgctgcaaaattttgttctttaccatctggaacgtcttctttgtcaatgtcctgtcaggatccgtgctaaatcagctaaatgtcttcactagaccaagggatatgccatctatgcttgccgaacttgtaccaaagcaggcaactttcttcatcacttatgtcctcacatcaggatgggcaagtctatgctccgagatattgcaagtgtacaacttagtatataacttcttcagaaaatgtatattttgctaccgggatgatccagaatatggctactctttcccttaccatactgaagtcccgaaagtcctcctgttcaacctgcttggcttcacattttcgataatggcacctctcatactgcccttcttgctagtctacttttgcctcggctacctagtgtatcgcaatcagatcctaaatgtctactacccaaagtacgaaatgggagggaaactgtggccaatcatgcacagcaccttggttttcgccctggttttgacacagaccatagctcttggagtgttcaccataaagcacgctactatatcttcagggttcaccgtcctactaatcatcgggacagtcctcttccatcagtattgcagacaccggttttcaagcatattcaactccttttctgcccaggatctgatagagatggacagagacgatgaacaatccgggaggatggaggagatccacaagcaccttctggacgcctactcccaaggcaccaccaacatggacaactccagttcttccaggaatggaggggctccaatcgaaatgatcatggaagaccctgcgcaggatgcacaggattctaaccaagaactctgtgacgccgtgaaggaagtgactgggtcgattcaggaacatgccgacgagatgtga

SEQ ID NO: 419 - protein, 743 aa, Oryza sativa
MEFSALLTSAGINIGLCALFLSLYSVLRKQPHNYGVYFGRRLAEEKFRQQVDYFSLERLLPTAGWIVKAYWCTEEEIRRVAGLDSVVFLRLFIFSIRIFSITSLVCIFGVLPVNYHGKETNHGRIPAESLNVFTIANLKEGSRMLWVHCVALYVITISACILLYYEYKYISRKRLAHITGSPPGPGHFSVIVRSIPKSDNELLDDTIRNFFVNYHGSSYLSHQMIYRKGSMQKFVDNAERVYRKFVRVKMSSFGQSRRSDLSRCGLCGVRASSFQQYRNKFINSKKPDLSDPEVIEAQKDCPGAIVFFKTRYAAIVASRILQSSNPMLWVTDFAPEPRDVYWSNLWIPYRQIWLRKIATLAASVAFMFVFIVPVAFVQSMMQLDQIEQLFPSLKNMLKKPFFVKLVTGYLPSVVLLLSLYTVPPLMMFFSSIEGSISRSGRKKSACCKILFFTIWNVFFVNVLSGSVLNQLNVFTRPRDMPSMLAELVPKQATFFITYVLTSGWASLCSEILQVYNLVYNFFRKCIFCYRDDPEYGYSFPYHTEVPKVLLFNLLGFTFSIMAPLILPFLLVYFCLGYLVYRNQILNVYYPKYEMGGKLWPIMHSTLVFALVLTQTIALGVFTIKHATISSGFTVLLIIGTVLFHQYCRHRFSSIFNSFSAQDLIEMDRDDEQSGRMEEIHKHLLDAYSQGTTNMDNSSSSRNGGAPIEMIMEDPAQDAQDSNQELCDAVKEVTGSIQEHADEM

SEQ ID NO: 420 - DNA, 2304 bp, Oryza sativa
atgggttctctcacagatatcggcgtcgccgcaggaataaacatactgtccgcattgggttttcttctcgcatttgcggttctcaggatacagcctatcaacgacagggtctactttcccaaatggtacctcaaagggacaagaagcagcccaagaagcatgggaacggttttctcaaagtttgtcaatgctgatctctcgacgtatatccgcttcctgaattggatgcctgcagcgctgcaaatgcctgagcccgagttgattgagcacgcaggcctcgactccgcggtatatgtccgcatatatcttcttgggttaaaaatatttgtgccgattgctgtgctggcattcattgtccttgttcctatcaactgggctagtggaactttggagaaggaaaagagtctaagttatgatcaaattgacaagctttcaatatctaaccttggaaaaggatcgaaaagattttgggcacacatagtgatggcctatgtatttacgttttggacgtttttcgtgttgtatcgtgaatacaaggttgtaacaactatgagattgcgctttcttgctattcagaatcgtcgagctgatcagtttacggtcctggtgagaaatgtaccacctgacccagatgaaacagttagtgagcatgttgagcacttctttgctgtcaatcatcgtgatcattatctcagtcaccagaccgtatacaatgcaaacacccttgccggtttggttgagcagaagaaaggcttgcaaaactggctggtctactacgaaaaccagcatgctaaaaaccctgcaaaaaaaccaactatgaagacaggattgtggggcctttgggggaaaagagtggatgctatagaacactacaccactgccattgaggagttatgcaaacaggaagatgaggagagacacaaggtgatcactgatcctaatgctattatgccagctgcatttgtatctttcaaaagccggtggggagctgctgtttgcgctcaaacgcaacagacgagcaatccaacgttgtggcttaccgagtgggccccagaacctcgggatgttttctggcctaatctcgcgatccctttcgtcgagctctcagtccggaggcttatcatggccgttgcactcttctttctgacctttttcttcatgattccaattgcaattgtccaatcaatggcaaacttggatgacattgaacggatgcttcctttcctgaaacctataatagaaagaaattcactgaagtcaattgtgcaaggtttcttgccaggaatcgcattgaaaatcttccttatacttctcccaacatttcttgtgatgatgagcaaaattgaaggtcatacatcactatctggattggacaggaggactgcgtcgaagtattatttgttcctatttgtcaatgtgttcttggggagtgtaataactggaacagcgttccaacaactcaacaattttatccatcagtcagctaataaaattccagagattgtcggagaatccatccccatgaaagcaacatttttcatcacatatgtaatggttgatggctgggctggtgttgccgctgaggttcttaggttgaagccattggtcatgttccatataaagaatactttcttggtcagaaccgagcgagatcgagagcaggccatggaccctgggagcctggattttggcaccacagaaccaaggatacaactgtactttctgcttgggcttgtatatgctgtcgtgacaccaattcttctacctttcatcatagtgttctttagccttgcctatctagtattcagacaccagatcattaatgtctacaatcagcaatatgagagtggcgcgcaattctggccagatgtccaaagacgactggttatagcattgatagtatcacaaatcctcctgttgggactgctgagcacgcaggaagcagagaaatccactgttgctcttcttcctcttcctgtactgtccatatggttccactatgtttgcaagggccgctttgagccagcgtttataaagttccccctgcaggatgcaatggtaaaggatacactggaacgggcaaatgacccaaccctgaatttgagagagtacctgaaggatgcatatgtgcacccagtgttccaaaaaaatgacatatatgagtttgctggcatcgacgaggaagagaagaaccccatggttgcaacgaagcgccaatcgcgaatgaacacaccagtagatagcaagttcaattccagttctggcactaatgaaggagagttcagtcggatggctcctacctga

SEQ ID NO: 421 - protein, 767 aa, Oryza sativa
MGSLTDIGVAAGINILSALGFLLAFAVLRIQPINDRVYFPKWYLKGTRSSPRSMGTVFSKFVNADLSTYIRFLNWMPAALQMPEPELIEHAGLDSAVYVRIYLLGLKIFVPIAVLAFIVLVPINWASGTLEKEKSLSYDQIDKLSISNLGKGSKRFWAHIVMAYVFTFWTFFVLYREYKVVTTMRLRFLAIQNRRADQFTVLVRNVPPDPDETVSEHVEHFFAVNHRDHYLSHQTVYNANTLAGLVEQKKGLQNWLVYYENQHAKNPAKKPTMKTGLWGLWGKRVDAIEHYTTAIEELCKQEDEERHKVITDPNAIMPAAFVSFKSRWGAAVCAQTQQTSNPTLWLTEWAPEPRDVFWPNLAIPFVELSVRRLIMAVALFFLTFFFMIPIAIVQSMANLDDIERMLPFLKPIIERNSLKSIVQGFLPGIALKIFLILLPTFLVMMSKIEGHTSLSGLDRRTASKYYLFLFVNVFLGSVITGTAFQQLNNFIHQSANKIPEIVGESIPMKATFFITYVMVDGWAGVAAEVLRLKPLVMFHIKNTFLVRTERDREQAMDPGSLDFGTTEPRIQLYFLLGLVYAVVTPILLPFIIVFFSLAYLVFRHQIINVYNQQYESGAQFWPDVQRRLVIALIVSQILLLGLLSTQEAEKSTVALLPLPVLSIWFHYVCKGRFEPAFIKFPLQDAMVKDTLERANDPTLNLREYLKDAYVHPVFQKNDIYEFAGIDEEEKNPMVATKRQSRMNTPVDSKFNSSSGTNEGEFSRMAPT

SEQ ID NO: 422 - DNA, 2301 bp, Oryza sativa
atggccactgtttctgacatcggcctctccgcggctatcaacgtctcgatggccgttgcattcttgctggtctttgcttttctacgattacagcccatcaacgatagggtttactttccaaaatggtacctcagaggaatgagagacagccctgtttcctctggtgctgcagtgcaaaaggttgtcaatttaaacatgagatcatacttgaaatttttaagttggatgccggctgctctcaagatgccagaggatgagttgatcaatcatgcaggccttgattccgctgtctatctacggatatacctaacagggatcaagatattcgttccaatatcaattttagcttcgcttgttctgttccctgtgaactggacaaatgacaccctagacagcatgaaggtagtccacagtaaaattgacaaactttcaatatcaaacataccttatgggtcaaacaggtttgttactcacttggttatggcttatgctgtcacgttttggacctgctatgtactgttccgagagtatgagataattacaacgatgagattgcggtttcttgcttcagagaaacggcgaccagaccagtttacagttcttgtgcggaatatacctccagatcctgatgaatcaattagtgagctcgtggagcatttcttccttgttaatcatcctgatcattatctaagacaccaggtggtttacaatgcaaataaacttgctgatctggttgagaagaagaagaaactgcaaaattggcttgattactaccagctcaagtatgaaagaaatccatcaaaaaggcccaccactaagactggctttcttggctgttttggttccgaggtggatgccattgaatactacaaagcagagattgagaagattgggaaagaagaagctgatgagcgtcaaaagatcatgaaggatccccagtcagctgttccagcagcctttgtttcatttcgttcacggtggggggctgctgtttgtgctcagacacagcaaaccagtaatccaacagtctggataactgaatgggctccagaacctcgtgatgtctactggaataatctatccattccatttgtgtccctcacagttaggaggctgatagttgctgtggcattcttcttcctcaactttttttatgtcattccaatagcattcgtgcaatctcttgcaagccttgaaggaatagaaaaggcgcttccatttctgaaacccttaatcaaaattgatgtcatcaaatcattcatccaaggttttcttccaggaattgctttgaaggtcttccttatattgcttccaactatactgatgtttatgtctaagtttgaaggattaatatcacagtcatcactggagcgaagatctgcatctaaatattatatcttcttgttcttcaatgtatttttgggaagcatcgttacaggatctgctttagatcagcttaaggcatacattcatcagtcggcaaatgaaataccgagaaccatcggtgtagccattccaatgagggcgacttttttcataacatatgtaatggttgacggttggactggtgtagctggtgaaatattgagattgagggcacttataatcttccatttgaaaaactttttcttggtgaagactgaaaaggacagagaagaggcaatggatcctggtagtatctgttttgattggtgtgaaccacgtatacagctatatttcttacttggccttgtctatgctgtggtgacaccgttattgcttcctttcatattggtattcttcgggctggcatatgttgtctaccgccaccagataataaatgtctacaatcaacaatacgagagtggtgcacagttttggccgagtgtgcacgggcgcataatcattgcattgatcgtatcacagctacttcttattggactgttgagtacaaaaggtttcgaggagacgacaccagttcttgttgttcttcctgtgttgacgttttggttttacaagtactgcaagaaccggtttgagcctgcatttgtgaggaacccactacaggaagcgatgaggaaagacaccctggaacgggcaagggagccaaccttcgatctgaaagcgtacctggccaatgcgtacctgcacccggtgttcaaaggcagggaggaggaggacaatatgtcaatatccgaggatgtcgggatggaggaggtgatcgtgccgaccaagcgtcaatctcgccggaacactcccgcccagagcaagtacgaaggctccgacacgctctctcttcctgaaactgtacacgaacgatag

SEQ ID NO: 423 - protein, 766 aa, Oryza sativa
MATVSDIGLSAAINVSMAVAFLLVFAFLRLQPINDRVYFPKWYLRGMRDSPVSSGAAVQKVVNLNMRSYLKFLSWMPAALKMPEDELINHAGLDSAVYLRIYLTGIKIFVPISILASLVLFPVNWTNDTLDSMKVVHSKIDKLSISNIPYGSNRFVTHLVMAYAVTFWTCYVLFREYEIITTMRLRFLASEKRRPDQFTVLVRNIPPDPDESISELVEHFFLVNHPDHYLRHQVVYNANKLADLVEKKKKLQNWLDYYQLKYERNPSKRPTTKTGFLGCFGSEVDAIEYYKAEIEKIGKEEADERQKIMKDPQSAVPAAFVSFRSRWGAAVCAQTQQTSNPTVWITEWAPEPRDVYWNNLSIPFVSLTVRRLIVAVAFFFLNFFYVIPIAFVQSLASLEGIEKALPFLKPLIKIDVIKSFIQGFLPGIALKVFLILLPTILMFMSKFEGLISQSSLERRSASKYYIFLFFNVFLGSIVTGSALDQLKAYIHQSANEIPRTIGVAIPMRATFFITYVMVDGWTGVAGEILRLRALIIFHLKNFFLVKTEKDREEAMDPGSICFDWCEPRIQLYFLLGLVYAVVTPLLLPFILVFFGLAYVVYRHQIINVYNQQYESGAQFWPSVHGRIIIALIVSQLLLIGLLSTKGFEETTPVLVVLPVLTFWFYKYCKNRFEPAFVRNPLQEAMRKDTLERAREPTFDLKAYLANAYLHPVFKGREEEDNMSISEDVGMEEVIVPTKRQSRRNTPAQSKYEGSDTLSLPETVHER

SEQ ID NO: 424 - DNA, 2196 bp, Oryza sativa
atggacaccgcgtcgttcgtgacgtcgctgctgacgtcgttcgtgatcttcgtcgtgctggtgctggtgttcacgtggctgtcgagcaggccgggcaatgcgccggtgtactacccgagcgtcctgctgcgggggctcgacccgtgggaggggcgggggcgggggacgaggagccccgtcgggtggctgcgccaggcgatctccgcctcggagggtgacgtcgtcgccgccggcggggtcgacgccgccgtctacctcgtcttcctctcctccgtgttgtccatcttggtgttctctgggattgtgctgcttccagttctgctacctgttgctgctactgacgataacctgaacctggaaagggctattggcctgaagaatggcaaaacaccccagaacttcacagagctcgagaaattagcactgggcaatgttcaagaacatagccgaaggctgtgggcatttctattatcagtctattgggtctcttttgtcacgtacttcgtactatggaagtcctacaagcatgtttctaatatgagagcggctgcaagatcaacaccagatgttaaaccggaggagtttgctgtgttggtgagagatgttcctaagccacctcctgatcaaactataaaggattctgtagactcatatttccgagcacttcatcctgataccttctacagatcaatggttgtgactgaccacacaaaggctgacaaaatttatcaagagattgaaggtcacaaacagaaaattgctcgtgctgaagttgtctatgcggagtctaaaacaacaggcaagcctgagggcaccaagcctacgcatcggattggatttcttggtcttatcggtaaaaaggttgatacaattgagtattgtaatgaccaaatcaaggagttgctgcccaaactggaggccgaacagaagactacccttcgtgagaaacagcaacaggctgcaattgtgtttttcaacagaagatctgctgcagcttctgcatctcagactctccatgctcagatgtttgataaatggactgttgagcaggctcctgaaccacgccagataatatggtctaatctttccaagaaaatatatgagaggcaaatcagacaggttgtggtctataccattgtctttctcacagtggttttctatatgattcctattactgctatctctgctcttacaactttggagaagttgagggagaagcttccctttctgaaggtggtggtggaccaaccgaaaatcaagactgtcctacaggcttacctcccgcagcttgcacttattgttttccttgctttgctgcctagtcttctaatgttcctctcaaagctggaggggattccttcacagggtcatacagttagggcagcagcagggaagtacttctacttcattgtgttcaatgtcttccttggggttactattagttccacattgttcagtgctttgacaaccataatcaataaccctcctgggattgtgaacatgcttgccagcagccttccaggaagtgcaactttcttccttacatttgttgcactgaaattctttgttggttatgggcttgagctctctcgcttggtccctcttatcattttccacctgaagaggaagtacctatgcaagaccgaggatgaagtgagagcagcttgggctccaggcgacctaggatataacaccagggttccgaatgacatgctcatagttacaatagtgctgtgctactctgtcattgcacctctgattattccatttggtgttgcttactttgctcttggatggattatagtgaaaaatcaggttctccgagtttatgttcccagctacgagagcaacgggcgaatgtggccacatatgcacacaaggatcattgcagctctactgatttaccagatcaccatggttggtgtcatcctgctgaagaagttcttgtactcccctgttcttgtgcccctcatcccaataagcttcatcttcgcctacatttgccatatgcggttctacccggcgttcgccaagacccctctcgaggtggttcagcacaacgtgaaagacacgccgaacatggatgccgtctacacctcctacatcccggcttgcctgaagcctgagaagctagaggatgtggatatcttcgaagacgcccagttgcacaccacctccagagccccatccatctaa

SEQ ID NO: 425 - protein, 731 aa, Oryza sativa
MDTASFVTSLLTSFVIFVVLVLVFTWLSSRPGNAPVYYPSVLLRGLDPWEGRGRGTRSPVGWLRQAISASEGDVVAAGGVDAAVYLVFLSSVLSILVFSGIVLLPVLLPVAATDDNLNLERAIGLKNGKTPQNFTELEKLALGNVQEHSRRLWAFLLSVYWVSFVTYFVLWKSYKHVSNMRAAARSTPDVKPEEFAVLVRDVPKPPPDQTIKDSVDSYFRALHPDTFYRSMVVTDHTKADKIYQEIEGHKQKIARAEVVYAESKTTGKPEGTKPTHRIGFLGLIGKKVDTIEYCNDQIKELLPKLEAEQKTTLREKQQQAAIVFFNRRSAAASASQTLHAQMFDKWTVEQAPEPRQIIWSNLSKKIYERQIRQVVVYTIVFLTVVFYMIPITAISALTTLEKLREKLPFLKVVVDQPKIKTVLQAYLPQLALIVFLALLPSLLMFLSKLEGIPSQGHTVRAAAGKYFYFIVFNVFLGVTISSTLFSALTTIINNPPGIVNMLASSLPGSATFFLTFVALKFFVGYGLELSRLVPLIIFHLKRKYLCKTEDEVRAAWAPGDLGYNTRVPNDMLIVTIVLCYSVIAPLIIPFGVAYFALGWIIVKNQVLRVYVPSYESNGRMWPHMHTRIIAALLIYQITMVGVILLKKFLYSPVLVPLIPISFIFAYICHMRFYPAFAKTPLEVVQHNVKDTPNMDAVYTSYIPACLKPEKLEDVDIFEDAQLHTTSRAPSI

SEQ ID NO: 426 - DNA, 2433 bp, Oryza sativa
atggcgacgctgccggacctgggtgtgtccgccttcatcaacatcttgggcgccttcgtcttcctcctcatcttcgccgccctccgcctccagcccatcaacgaccgcgtctacttccccaagctctacctcactggccagcgacgccaccaccctcaccctcatggcttcgtcaacctcgacctctgctcctacctccgcttcctcgcctgggtccccggcgccctccgcatgtcccagcccgacctcatccaccacgccggcctcgactccgccgtctacctccgaatctacacgctcggcctcaagatatttttgcccatcatgactgtcgccttgctggttcttattccagttaatgtctctggtggcacgttacttaatttacgaaaagaaattgtctttagtgatattgataagctttccatatcaaatgtcaaccctggatccaacaggttctttatccatctattaatggcatatgtgttcactttttggacttgctttatgctatacaaagagtatagcaatgtggcatttatgagattgcacttcctggcttctcagaagcgttgtgctgatcagttcactgtgattgttagaaacatacctcatgtttcaagccattcaacatctgaaacagtggatgaattcttccgtaggaatcatccagaccactatcttggtcagcaggctgtttataacgcaaacaggtatgctaaacttgtgaagaaaaaagagaggcttcaaaactggttggattactaccagctgaagtttgaaaggcatcctggaaaaagaccaattggaaggacagggtgccttggtttctgcggtagagaagtggatcaaatcgactattaccgtgctagaatcagcgagcttgataagaagcttgcatctgagcgtcaaagagttctcaatgacccaaaagctgttatgccagttgcttttgtgacatttgactcgagatggggagctgctgtatgtgcacagacacaacagtcaaagaatcctacccaatggctaactgattgggctcctgaaccgcgggatgtatattggcagaatcttgccattccatttttctctctcagtatccgcaagttcctgatatccattgcagtttttgctctggtgttcttctacatgatacctatagcttttgtgcaatcacttgccaatcttgagggtattgaaaaagttgcacctttcctaaggcctgtgatagacacaccagtggtgaaatccttcctgcagggtttccttccgggtttggctttgaagatttttctgtatatcctcccaacggttttgatgattatgtcaaaggttgaaggttatgtgtctttatcatctctggaaaggagggctgcttcaaaatattactacttcatgctggtgaatgtatttcttggaagcataatcgctggcacagcttttgaacagctaaatgcatttttccatcagccaccttcacaaataccaaggaccattggagtagctataccaatgaaagctacattttttatgacatacataatggttgacgggtgggctggcatcgcgaacgagattcttcgagtgaagccgctggtgatataccacctgaagaacatgtttattgtgaagacggagcgggacagggagagggcaatggatccgggcagcattgggcttgcagagaacctcccatcactgcagctgtattttcttcttgggcttgtgtatgctgtggtcacccccattctcctccctttcattatcatcttctttgccttcgctttcctcgtgtacagacaccagatcatcaacgtgtacaaccaagaatacgagagtgctgctgcgttttggcctcaggtgcactctcgcataatagcgagcttgctgatctcgcatgtaactctgtttgggctgatgagcaccatgaaggctgcctactccaccccgctgcttatctttctgccactcctcaccatatggttccacaagtactgcaagagccgtttcgagcctgctttccgcaagtaccctctagaggaagcgatggagaaggacaatctggagcgcacgtcggagccaaacctgaacctcaaatcgtacctgcagaacgcttacctgcaccccattttccacatgtttgagcagcagcagcagcaggagcaggagcagcaacgggaggagaaggtagaggtgcgaatcgacaaggcgcagcaacatcatcatcggcaggtagaggaggaagaggaggagagcaagagcagccaggctacaacacactactaccaccatcaccatgagcagaccacaacgacgacacaccaccattaccatcagcatgagcatatgagccactaccacatgggcccctccgacacagctgactcaccctcgccgccgcactttgtctaccattatggcgtcgacccttga

SEQ ID NO: 427 - protein, 810 aa, Oryza sativa
MATLPDLGVSAFINILGAFVFLLIFAALRLQPINDRVYFPKLYLTGQRRHHPHPHGFVNLDLCSYLRFLAWVPGALRMSQPDLIHHAGLDSAVYLRIYTLGLKIFLPIMTVALLVLIPVNVSGGTLLNLRKEIVFSDIDKLSISNVNPGSNRFFIHLLMAYVFTFWTCFMLYKEYSNVAFMRLHFLASQKRCADQFTVIVRNIPHVSSHSTSETVDEFFRRNHPDHYLGQQAVYNANRYAKLVKKKERLQNWLDYYQLKFERHPGKRPIGRTGCLGFCGREVDQIDYYRARISELDKKLASERQRVLNDPKAVMPVAFVTFDSRWGAAVCAQTQQSKNPTQWLTDWAPEPRDVYWQNLAIPFFSLSIRKFLISIAVFALVFFYMIPIAFVQSLANLEGIEKVAPFLRPVIDTPVVKSFLQGFLPGLALKIFLYILPTVLMIMSKVEGYVSLSSLERRAASKYYYFMLVNVFLGSIIAGTAFEQLNAFFHQPPSQIPRTIGVAIPMKATFFMTYIMVDGWAGIANEILRVKPLVIYHLKNMFIVKTERDRERAMDPGSIGLAENLPSLQLYFLLGLVYAVVTPILLPFIIIFFAFAFLVYRHQIINVYNQEYESAAAFWPQVHSRIIASLLISHVTLFGLMSTMKAAYSTPLLIFLPLLTIWFHKYCKSRFEPAFRKYPLEEAMEKDNLERTSEPNLNLKSYLQNAYLHPIFHMFEQQQQQEQEQQREEKVEVRIDKAQQHHHRQVEEEEEESKSSQATTHYYHHHHEQTTTTTHHHYHQHEHMSHYHMGPSDTADSPSPPHFVYHYGVDP

SEQ ID NO: 428 - DNA, 2088 bp, Oryza sativa
atgattctgtcggcgctcgcgacttcggtggggatcaacctggggctgacggtgctcctcgcggcggcgtacacgctgctccggcggcgcccgccgtacgtcgccgtgtactcgccgcggcggccgtacgcgccgccggagccgtggctgcccgcggcgtggcgccgcaccgaggccgacgtccacgccgccgccgggctcgacggcgtcgtcttcctccgcatcttcgtcttcagcattagggtgttcgcggcggcggcggtggtgggggtgggagtgctgatgccggtgaacttcatgggggaccagctgcggcagattgacttctccgatctgcccaacaagtccgtcgatctcttcagcgtctccaacgtgcaggatggctccaacaaattgtggctccacttttcggctgtgtacatcataactggaattacatgctacctcctttattatgaatacaaatatatttctggcaagaggctcgaatattttatgacatcaaaaccactacctcagcatttcacagttctagttcgagctatacctgtaaccaatggtgtgtctgtgagtgatgctgttgataagttcttcaaagagtaccattcatctacctacttgtcacacactgttgttcatcaaactggcaaactccgccgccttcttaatgacgctgagaatatttgcacaaagcttgccaacttgaagtctgtacggcgtacttctggagatcctccaggaaaatttcttggaatatttggcagaaatgatcttgttgggaaatatcagaaaaggctggaggacctagaagaaaatgttagaatggaacaatcagacactactaggagcagacaggaagttcccgctgcttttgtgtcattcagatctcgatatggtgctgcaaatgctatttacataagacaatcagacaagcctactgagtggcagactgagcatgctcctgatccccatgacgtttattggcctttcttttcaacatcattcatggacagatggatatccaagtttgtagtctctgtagcttctattctcctgatactcgtctttctcctagtttcggcatttgttcaaggactcacctatatggaacagctagagacatggttgcctttcctgagaaatatactggaaatagctgttgtcagtcagttggttacaggatatcttcccagtgtcattcttcactttctttcctcttatgtgccctctataatgaagctgttttcaacaatgcaaggattcatctctgttagtgggattgagagaagtgcttgcaacaaaatgcttcggtttacaatatggagtgtgttctttgcaaatgttcttactggctcagtacttggtcaactcgagatattccttgatccgaaggaaatccctaaaaggcttgcagttgttgtaccagcacaggcctctttctttattacatatgttgtgacatcttggacaagtatagcatcagaacttactcaaactgctgcccttttattccatttgtggggtagctgtgcaaaatgctgcaagagggatgagtccaaacctccatcaatgcattaccatagtgaaattcctcgggttctcctgtttggacttcttgggctcacatacttcattgtatccccacttatcctcccatttgtactggtttacttctgccttggctacttcatatatcgtaatcagctttttaatgtatattcacccaagtatgacactggtggaagattctggcccattgtgcacgggggaacaatattttctctggtgctgatgcatgttattgcaattggagtatttggattgaagaaacttccccttgcatcaagtttgctggtacctcttccagtgctgacccttctgttcaatgaatactgccggaacagatttttaccgatcttcgaagcatattctactgagtcattgataaagaaagacagagaagaagagagcaaaccagaaatggcagaattcttcagcaatcttgtaaatgcgtactgtgacccggcgatgaaacctatccaacactcctcgaattcagatgaacgcactacacctctattgtcttag

SEQ ID NO: 429 - protein, 695 aa, Oryza sativa
MILSALATSVGINLGLTVLLAAAYTLLRRRPPYVAVYSPRRPYAPPEPWLPAAWRRTEADVHAAAGLDGVVFLRIFVFSIRVFAAAAVVGVGVLMPVNFMGDQLRQIDFSDLPNKSVDLFSVSNVQDGSNKLWLHFSAVYIITGITCYLLYYEYKYISGKRLEYFMTSKPLPQHFTVLVRAIPVTNGVSVSDAVDKFFKEYHSSTYLSHTVVHQTGKLRRLLNDAENICTKLANLKSVRRTSGDPPGKFLGIFGRNDLVGKYQKRLEDLEENVRMEQSDTTRSRQEVPAAFVSFRSRYGAANAIYIRQSDKPTEWQTEHAPDPHDVYWPFFSTSFMDRWISKFVVSVASILLILVFLLVSAFVQGLTYMEQLETWLPFLRNILEIAVVSQLVTGYLPSVILHFLSSYVPSIMKLFSTMQGFISVSGIERSACNKMLRFTIWSVFFANVLTGSVLGQLEIFLDPKEIPKRLAVVVPAQASFFITYVVTSWTSIASELTQTAALLFHLWGSCAKCCKRDESKPPSMHYHSEIPRVLLFGLLGLTYFIVSPLILPFVLVYFCLGYFIYRNQLFNVYSPKYDTGGRFWPIVHGGTIFSLVLMHVIAIGVFGLKKLPLASSLLVPLPVLTLLFNEYCRNRFLPIFEAYSTESLIKKDREEESKPEMAEFFSNLVNAYCDPAMKPIQHSSNSDERTTPLLS

SEQ ID NO: 430 - DNA, 2292 bp, Oryza sativa
atgaaaatcagcggacttctgacctctgctggcatcaatatcgctctttctgtgctgtttatatcgctctattctgttctgaggaagcagccagccaatgtcagggtctactttgggaggaggattgccgaggagcataatcggctccgagaagcttttatcttggagagatttgtaccatctactggctggatagtaaaagccctgcagtgtaccgaggaagagatcttggctgctgctgggctagatgctgttgttttcaatagaattctagtattcagcttacgcatcttctctctagctgccattctgtgtgtgtttggaattctaccactgaactactttgggcaagatatacatcatgttcggattccttcagaatcattggatatctttacaattgggaatgtgaaagtgagatcaagatggctttgggtccattgtgtagccttgtacataatatcaggagtagcttgcattctcctatatcttgagtacaagcacattgctaggctgaggctccgtcatcttacttgtgcaatgcccaatccaagccattttactgtccttgttcgtggaataccaaaggaaaccaaagaatcatgcagtaatgctattgatgatttcttcaccaagtaccatggatcaagctacctgttccatcaagttgtttacaaagttggaaaagttcagaagataatgactggtgctaagaaggcatacaggaaattcaaacattttacagacagcactattgatcagaggtgtcgagcaatttcataccggtgctgtctgtgcggagcctcatctaattctttccagctgttggcaactgggcttgagcagaatcaggggaaatctgaccttcaagattccagcttgaaactagatgatcaggaatgtgcagctgcttttgtatatttcagaactcggtatgctgctcttgttgcctcagaaatactccaaacatctaaccctatgaaatgggttactgatctagctccagaaccagatgatgtgtattggtcaaatctttggctaccttataagcagctttggattcgccgaatagctacgctccttggttcaattgtttttatgttattctttctgataccagtgacatttatacaaggactatctcagctagagcagttgcagcagaggcttcctttcctgaaggggatactggagaagaaatacatgagccagcttgtaactgggtaccttcccagtgtcatactgcaaatatttttatatgccgttgcaccgataatgatattattttctacattagaggggcctatatctcacagtgaaaggaagaggagtgcttgctgtaaagtgctgtacttcactgtttggaacatattctttggaaatgtactatctggtactgtcataagccaattgaatgtgttatcaagcccaaaggacatccctgtccagcttgctagagctatacctgtccaggctaccttctttatcacctatgttctgacatcaggatgggccagtttatcatctgaacttatgcaattatttggtttaatatggaactttgtgaggaaatatattctacgtatgccagaagacacagagtttgttccctcattcccatatcacacagaagtgccaaaagttttgctgttcggactactgggcttcacatgctctgtactggcacctttgatcttaccttttctgttagtgtacttcttccttggttacatcgtgtaccgcaatcagttgctcaatgtttaccgcacaagatatgacacagggggtttgtactggccaatcgcacacaacgcagtgatattctctctcgtgctcacacagattatctgccttggtgtatttggcctgaaagaatcaccagtagctgcaggcttcaccatacctcttatcatcctcactctgttattcaatcagtattgcagaaatcgacttctcccattattcagaactaccccagcacaggatttaattgacatggacagggaagacgaacggtcaggaagaatggatgaaattcaccaccggcttcattctgcctattgtcagttccacgacactgaagatatacccttggagaaaattcagactgtcgggagcgatgaggaacaagggtgtagctctgataagtcgaatggaaaagaaagcttcgaggaacccagagcggagttgtctcacccaacactgaatggactcccagttagccgtcttcggcatgctgtgaagtcgattactttccttgtcagattgcagaaaagaggtttgtcagaatag

SEQ ID NO: 431 - protein, 763 aa, Oryza sativa
MKISGLLTSAGINIALSVLFISLYSVLRKQPANVRVYFGRRIAEEHNRLREAFILERFVPSTGWIVKALQCTEEEILAAAGLDAVVFNRILVFSLRIFSLAAILCVFGILPLNYFGQDIHHVRIPSESLDIFTIGNVKVRSRWLWVHCVALYIISGVACILLYLEYKHIARLRLRHLTCAMPNPSHFTVLVRGIPKETKESCSNAIDDFFTKYHGSSYLFHQVVYKVGKVQKIMTGAKKAYRKFKHFTDSTIDQRCRAISYRCCLCGASSNSFQLLATGLEQNQGKSDLQDSSLKLDDQECAAAFVYFRTRYAALVASEILQTSNPMKWVTDLAPEPDDVYWSNLWLPYKQLWIRRIATLLGSIVFMLFFLIPVTFIQGLSQLEQLQQRLPFLKGILEKKYMSQLVTGYLPSVILQIFLYAVAPIMILFSTLEGPISHSERKRSACCKVLYFTVWNIFFGNVLSGTVISQLNVLSSPKDIPVQLARAIPVQATFFITYVLTSGWASLSSELMQLFGLIWNFVRKYILRMPEDTEFVPSFPYHTEVPKVLLFGLLGFTCSVLAPLILPFLLVYFFLGYIVYRNQLLNVYRTRYDTGGLYWPIAHNAVIFSLVLTQIICLGVFGLKESPVAAGFTIPLIILTLLFNQYCRNRLLPLFRTTPAQDLIDMDREDERSGRMDEIHHRLHSAYCQFHDTEDIPLEKIQTVGSDEEQGCSSDKSNGKESFEEPRAELSHPTLNGLPVSRLRHAVKSITFLVRLQKRGLSE

SEQ ID NO: 432 - DNA, 2289 bp, Arabidopsis thaliana
atggatgtctcagcacttttaacgtctgctgggattaatatagcgatatgcgtagtgcttgtatcgctttattccattctacgaaagcagccagccaattattgtgtttactttggtcgattgctttctgacggaagagttaaacgtcatgatcctcgttggtatgagaggttcgcgccctctcctagttggctcgtgaaagcttgggaaaccactgaggaagagatgttggctgctgctggtctggatgctgtggttttcatcaggatggtcatttgcagcattcgtattttctcaatcgtcgcagtcgtttgccttgcctttgtgttacctgttaactattatggacaaaagatggagcacaaggaagtccatttggagtcattgggagtattcacaattgagaaccttaatccacgctcacgatggctctgggttcattgtctctcattgtacatcatatcctctgcagcatgtgctcttctttactttgagtataagaacatagccaaaaagaggcttgcccatattagtggatctgcctcaaagccaagtcattttactgttcttattcgtgctattcctcagtctcctgaccagtcctacagcgagacagtgagcaaatactttacaaattactatgcaccaagctatgtgtcgcacctaatggtctaccgtgatggcttcattcacagactgatgaatgagacggagaggatgtgtcaggctataaaacatgtttctcctgatttaagttgtaatccgagtttgaagtcatgcgtcctttgtggacctgcagccacaaattcttttcaaatcatctcgaacgagacagacagtgtcaaaggattggagcttggtgagttgactttgactacgacagaggaagaacgtcccgttgcttttgtgtttttcaagagtcgttatgatgctcttgttgtttcagaagttcttcaaacaccaaatcctatgttatgggtggcagacttggctccagagcctcatgatgttcactggagaaatctcagaataccttatcggcagctttggatgcgaagaatagcaacccttgttggtgcaattgccttcatgtttgtgtttctttttcctgttacctttgttcaagggctgactcaactaccaacgttatccaagaattttccttttctaaaagacctcttgaacaggaggtttatggagcaggtcatcacagggtatttaccaagtgtgattttggttctattcttttataccgttccgccattgatgatgtacttttcaaccttggagggatgtgtttctcggagtcaaagaaaaaaaagtgcatgtctcaaaattttatacttcaccatctggaatgtgttcttcgtcaatattctatcaggctctgttatcaggcagtttaccgtcttgaatagtgtgagggacgtacctgcacaacttgcgaaacttgttccagcacaggctggcttcttcatgacctattgtttcacgtctggttgggccggtttggcatgtgaaatcatgcaacctgtaggtcttatttggaatctgattgcaaaagttattgttaagaacaaggaggagtcatatgaaacacttaggtttccctaccatacagaaattccaagactacttttgttcgggctcctgggtttcaccaattcagtcatagcgcctctgatactgccgtttctgctgatctactttttcttcgcatatcttatatacaaaaatcagataatcaacgtctatattacaaagtatgaaagcggtggacaatattggcctgtttttcacaacactacaatcttttcactgatcttgtcgcaagttatagctctaggctttttcgggttaaagctatcaacggttgcttcaggtttcaccatcccgttaatccttctcactcttctatttagtgagtattgccggcaaaggtttgcgcccatattccagaaatatccagccgagattcttatcgctatggacagagcagatgagatgacaggaaagatggaagagatacataacaacttgaaagttgcatactctcagataccaacgtgttctgaagaatccagcaaagctggttgcacttctccttgctcagatcaggagttaccagattctgaagagttgaagcctgagaaagagaatcttaaagctgattacatatgggagttccagagaagtaaatctggtcttgatcttgaggtgaaatcctgtcccagtgcttccccaattcgtaattccccagggtttgccgagatctacaaacgaacatag

SEQ ID NO: 433 - protein, 762 aa, Arabidopsis thaliana
MDVSALLTSAGINIAICVVLVSLYSILRKQPANYCVYFGRLLSDGRVKRHDPRWYERFAPSPSWLVKAWETTEEEMLAAAGLDAVVFIRMVICSIRIFSIVAVVCLAFVLPVNYYGQKMEHKEVHLESLGVFTIENLNPRSRWLWVHCLSLYIISSAACALLYFEYKNIAKKRLAHISGSASKPSHFTVLIRAIPQSPDQSYSETVSKYFTNYYAPSYVSHLMVYRDGFIHRLMNETERMCQAIKHVSPDLSCNPSLKSCVLCGPAATNSFQIISNETDSVKGLELGELTLTTTEEERPVAFVFFKSRYDALVVSEVLQTPNPMLWVADLAPEPHDVHWRNLRIPYRQLWMRRIATLVGAIAFMFVFLFPVTFVQGLTQLPTLSKNFPFLKDLLNRRFMEQVITGYLPSVILVLFFYTVPPLMMYFSTLEGCVSRSQRKKSACLKILYFTIWNVFFVNILSGSVIRQFTVLNSVRDVPAQLAKLVPAQAGFFMTYCFTSGWAGLACEIMQPVGLIWNLIAKVIVKNKEESYETLRFPYHTEIPRLLLFGLLGFTNSVIAPLILPFLLIYFFFAYLIYKNQIINVYITKYESGGQYWPVFHNTTIFSLILSQVIALGFFGLKLSTVASGFTIPLILLTLLFSEYCRQRFAPIFQKYPAEILIAMDRADEMTGKMEEIHNNLKVAYSQIPTCSEESSKAGCTSPCSDQELPDSEELKPEKENLKADYIWEFQRSKSGLDLEVKSCPSASPIRNSPGFAEIYKRT

SEQ ID NO: 434 - DNA, 1128 bp, Arabidopsis thaliana
atggcaacactaggagatattggagtagcagcagcaatcaacatactcactgcaatcatcttccttttggcatttgcaatcttgaggattcaaccattcaacgatagggtttatttccctaaatggtatctcaaaggtataagaagcagccctttgcattcaggtgctcttgtcagcaagtttgtcaatgttaacttaggctcatacctccggttcttgaactggatgcccgcggctctaaagatgcctgagcctgagcttattgatcatgctggattggattctgctgtctacttgaggatttacttgatagggcttaagatctttgtaccgatagcgttacttgcttggtcgattcttgtacctgtcaattggactagtcatggtctgcaactagctaagcttcgtaatgtgacatctagtgatattgataagttatccatctcgaatatcgaaaatggatcagacaggttttggactcaccttgtgatggcttacgcattcacattctggacttgctatgttcttatgaaagagtatgagaaagtagctgctatgcgtttggcatttctccagaacgagcaacggcgccctgatcagttcacggttttggttaggaacgtaccagcggacccagatgagtccattagtgacagtgtggaacatttctttctagttaaccatccggaccattatcttacgcatcaggttgtgtacaatgcaaacgatttggcagcattagtagagcagaagaagagcacacagaactggcttgactattaccaattgaagtatacaaggaaccaggaacataagccgaggataaagacgggttttctcgggctatggggaaagaaagttgacgcaatcgatcattatatagctgaaatcgagaaattaaacgagcaaataatggaggagaggaaaaaagtgaagaaagatgatacaagtgtaatgccagccgcttttgtctcgtttaaaacacggtggggtgctgcggttagtgcacagactcaacagtcgagtgatccgactgaatggttaactgaatgggctcccgaggcacgagaagtgttttggtcgaaccttgcaataccttatgtctctttaacacatcgaaggcattga

SEQ ID NO: 435 - protein, 375 aa, Arabidopsis thaliana
MATLGDIGVAAAINILTAIIFLLAFAILRIQPFNDRVYFPKWYLKGIRSSPLHSGALVSKFVNVNLGSYLRFLNWMPAALKMPEPELIDHAGLDSAVYLRIYLIGLKIFVPIALLAWSILVPVNWTSHGLQLAKLRNVTSSDIDKLSISNIENGSDRFWTHLVMAYAFTFWTCYVLMKEYEKVAAMRLAFLQNEQRRPDQFTVLVRNVPADPDESISDSVEHFFLVNHPDHYLTHQVVYNANDLAALVEQKKSTQNWLDYYQLKYTRNQEHKPRIKTGFLGLWGKKVDAIDHYIAEIEKLNEQIMEERKKVKKDDTSVMPAAFVSFKTRWGAAVSAQTQQSSDPTEWLTEWAPEAREVFWSNLAIPYVSLTHRRH

SEQ ID NO: 436 - DNA, 2175 bp, Arabidopsis thaliana
atggagtttggatcttttcttgtgtccttagggacatcttttgttatcttcgtcattctcatgcttctcttcacctggctttctcgcaaatctggaaatgctcccatttattacccgaatcggatccttaaagggctggagccatgggaaggcacctccttgactcgaaacccttttgcttggatgcgtgaagctttgacttcctctgaacaagatgtcgttaacttatccggcgtcgatactgctgtccactttgtcttcttgagcactgttctggggatatttgcttgttccagtcttcttctcctaccaactctactgcctctagccgctacagacaacaacataaagaacacaaagaatgcgacagataccacaagcaaaggaacttttagccaacttgataatctatcaatggctaacatcacaaaaaaaagttcgaggctgtgggcgttcctaggagctgtttactggatatctttggtcacatatttcttcttgtggaaagcttataagcatgtctcttcattgagagctcaagctctgatgtctgctgatgtaaaacccgagcaattcgctattcttgttagggatatgcctgcaccacctgacgggcagacacagaaagagtttattgattcttatttcagagaaatataccctgagacattctacagatcgcttgtcgcaacagaaaacagcaaggttaataaaatatgggaaaaattggaaggttacaagaagaagcttgcgcgagcagaagcaatattagcagcaactaataaccgtcccacgaacaaaaccggcttctgtgggctagtcggtaaacaagtagacagcattgagtattacactgagctaatcaacgagtctgtagccaaactggaaacagagcagaaagcggttcttgctgagaagcagcaaaccgcagcagtggttttcttcacaaccagggttgctgctgcatcagcagctcagtctctgcactgccagatggttgataaatggactgtgaccgaagctcctgagccacggcagctcctatggcagaatctcaacatcaagctcttcagcagaataatccggcaatacttcatctacttctttgttgcagtgaccattctgttttacatgataccaatcgcgttcgtctctgccatcaccactcttaagaatcttcagaggattattccgttcataaagccggttgtggagataaccgccataagaaccgttttggagtctttccttcctcagattgcgctcattgttttcttggccatgttgccgaagcttctcttgtttctctccaaagccgaggggattccttcacagagccatgccattagggctgcttcagggaagtacttttacttctcggtctttaatgtcttcattggtgttacccttgctgggactttgttcaacacagtgaaggatatcgcgaaaaatcccaaactcgacatgattattaaccttttggctactagcctccctaagagcgcaactttcttcctgacctacgttgctctcaagttctttatcggttatggccttgagctgtctcggatcatacctttgataatcttccacctgaaaaagaagtatctctgcaaaaccgaagcggaggtcaaagaagcttggtacccgggagacttaagctatgcgactagggttcccggagacatgctcatcctcacaatcacgttctgctattcagtcattgctcctcttatcctcatattcggcatcacctactttggtttaggctggctagtcctcaggaatcaggcgttgaaagtgtacgttccatcatacgagagctatggaagaatgtggccgcatattcaccagcgcatactagcagcgttgtttctattccaagtggtaatgtttggctacttaggagccaagacattcttctacacggcccttgtgatccctctcattatcacctctctcatcttcggatatgtgtgccgccagaaattctacggagggttcgaacacacagctctcgaggtagcttgccgtgagctgaagcagagtccagacctagaggagattttcagagcatacattccgcatagcttgagctctcacaaaccagaagaacacgagttcaaaggcgcaatgtctcgttatcaagatttcaacgcaatagcaggcgtttaa

SEQ ID NO: 437 - protein, 724 aa, Arabidopsis thaliana
MEFGSFLVSLGTSFVIFVILMLLFTWLSRKSGNAPIYYPNRILKGLEPWEGTSLTRNPFAWMREALTSSEQDVVNLSGVDTAVHFVFLSTVLGIFACSSLLLLPTLLPLAATDNNIKNTKNATDTTSKGTFSQLDNLSMANITKKSSRLWAFLGAVYWISLVTYFFLWKAYKHVSSLRAQALMSADVKPEQFAILVRDMPAPPDGQTQKEFIDSYFREIYPETFYRSLVATENSKVNKIWEKLEGYKKKLARAEAILAATNNRPTNKTGFCGLVGKQVDSIEYYTELINESVAKLETEQKAVLAEKQQTAAVVFFTTRVAAASAAQSLHCQMVDKWTVTEAPEPRQLLWQNLNIKLFSRIIRQYFIYFFVAVTILFYMIPIAFVSAITTLKNLQRIIPFIKPVVEITAIRTVLESFLPQIALIVFLAMLPKLLLFLSKAEGIPSQSHAIRAASGKYFYFSVFNVFIGVTLAGTLFNTVKDIAKNPKLDMIINLLATSLPKSATFFLTYVALKFFIGYGLELSRIIPLIIFHLKKKYLCKTEAEVKEAWYPGDLSYATRVPGDMLILTITFCYSVIAPLILIFGITYFGLGWLVLRNQALKVYVPSYESYGRMWPHIHQRILAALFLFQVVMFGYLGAKTFFYTALVIPLIITSLIFGYVCRQKFYGGFEHTALEVACRELKQSPDLEEIFRAYIPHSLSSHKPEEHEFKGAMSRYQDFNAIAGV

SEQ ID NO: 438 - DNA, 1974 bp, Arabidopsis thaliana
atggtcattttcagcattcgtattttctttatagttgctgttatttgcattgcctttgtgctgcctgttaattattatgggcaaccgatggtgcataaggaaatccatttggagtcatccgaagtgtttacaattgaaaatcttaaagaaggctcaaaatggctgtgggttcattgtcttgcactgtacattataacctcagcggcatgtcttctgctctactttgagtatagcaccatagctaaaatgaggcttgggcatattactggatgtgcctcaaagccaagtcaatttaccgttcttatccgtgctattccatggtctcctgagcaatcttacagcgacacgctgagcaaattcttcacaaactactactcgtccagctacgtgtcccaccaaatggtctaccataatggcatcattcagagactgctgcgtgatgcggagaggatgtgccagactctaaaacacgtttctcctgaaatcaattgtaaaccgagtttaaggccatgcaccttttgtggaggacctacagccacaagttcttttcatatcctatcgaatgaggcagacagtgtgaaaggaatggagcttggtgagttgactatgactacgactacgacagagcaagaacgttcagctgcttttgtgttttttaagactcgctatgatgctcttgttgtttcggaggttctacaatcatcaaatcctatgttatgggtgacagacttagccccagaacctcatgatgtgtactggaagaatctcaacattccttatcgacaactttggatacggaaaatagcaacccttgttggtgcagttgctttcatgtttgtgtttcttattcccgttaccttcattcaagggctgactcaactagtgcagctgtctcacgcatttccttttctaagaggcatcttgagcaagaactttataaaccaggtcatcacagggtacttacccagtgtgatcttgattctatttttctatgccgttccaccattgatgatgtatttttcggccttggagggatgtatttcacggagtataaggaagaagagtgcttgcatcaaagtcttatattttaccatttggaatgtgttcttcgtgaatatattatcagggtctgttatcaggcaactgaatgtcttttctagtgtcagagacatacctgcacaacttgctagagcagtgccaacacaggctggcttcttcatgacctattgtttcacatctggttgggccagtttggcttgtgaaataatgcagcctatggctcttatctggaatctggtagcaaaagttgttaccaagaacgaggatgagtcatatgaaacacttaggttcccataccacaccgaaattcctcggctgcttttgtttgggctcctgggtttcaccaattcagtcatagcaccactgatactgccgtttttgctgatatactttttccttgcatatctcatatacaaaaatcaaatactcaacgtgtatattacgaagtacgaaagcggtggacaatactggcctattttccacaacacaacaatcttttcactgatcttgacacagattatagctttggggtttttcggattaaagctatcaacagttgcttcgggtttcaccataccgttaattcttctcacgttactttttagtgagtattgtcggcagaggtttgcgcccattttcaacaaaaatcctgcccaggttctcatagatatggacagagctgatgaaatatcaggaaagatggaagagttacataaaaaattgcataatgtatactcgcagataccattacactctcagaaatcatcgagtaaagctgaatgtagtaatcctttcaaaaagcaggagttaccagatcctgaaaaattgaagccagaggagggggatgcgatagctaaagagttatggggattccaaggcaatgaatctggtcaagaacatgacactaagtcctga

SEQ ID NO: 439 - protein, 657 aa, Arabidopsis thaliana
MVIFSIRIFFIVAVICIAFVLPVNYYGQPMVHKEIHLESSEVFTIENLKEGSKWLWVHCLALYIITSAACLLLYFEYSTIAKMRLGHITGCASKPSQFTVLIRAIPWSPEQSYSDTLSKFFTNYYSSSYVSHQMVYHNGIIQRLLRDAERMCQTLKHVSPEINCKPSLRPCTFCGGPTATSSFHILSNEADSVKGMELGELTMTTTTTEQERSAAFVFFKTRYDALVVSEVLQSSNPMLWVTDLAPEPHDVYWKNLNIPYRQLWIRKIATLVGAVAFMFVFLIPVTFIQGLTQLVQLSHAFPFLRGILSKNFINQVITGYLPSVILILFFYAVPPLMMYFSALEGCISRSIRKKSACIKVLYFTIWNVFFVNILSGSVIRQLNVFSSVRDIPAQLARAVPTQAGFFMTYCFTSGWASLACEIMQPMALIWNLVAKVVTKNEDESYETLRFPYHTEIPRLLLFGLLGFTNSVIAPLILPFLLIYFFLAYLIYKNQILNVYITKYESGGQYWPIFHNTTIFSLILTQIIALGFFGLKLSTVASGFTIPLILLTLLFSEYCRQRFAPIFNKNPAQVLIDMDRADEISGKMEELHKKLHNVYSQIPLHSQKSSSKAECSNPFKKQELPDPEKLKPEEGDAIAKELWGFQGNESGQEHDTKS

SEQ ID NO: 440 - DNA, 2310 bp, Arabidopsis thaliana
atggcgacattagcagatattggactagcagcagcgattaatattctaagtgcattgatatttctattgctatttgcaatcttgaggattcaaccattcaatgatagggtttatttccctaaatggtacttaaaaggtgttagaagcagccctgtgaattcgggtgctttcgttagcaagattatgaatttggactttcgatcatacgttcggtttttaaactggatgcctgatgctcttaagatgccagagcctgaacttattgatcatgctggtttggattctgctgtttacttgaggatttacttgattgggcttaagatctttggtccgattgcattactttcatggtcaattttagtacctgtaaattggacaagtgatggattgcagctagcaaaacttcgtaatgtaacatcgagtaatatcgataagctttcgatttcgaatgtcgaacgtggatcagacaggttttgggcacatcttgtgatggcttatgcattcacattttggacttgctatgtactaatgaaggaatatgagaaaattgctgcaatgcggttatcttttctccaatcagagaagcgacgtgctgatcaattcactgttctggttaggaacgtaccaccggactcagacgagtcgattagcgaaaacgtgcagcatttctttcttgttaaccacccagaccattatcttacacatcaggtggtgtacaatgcaaatgaattggctaaattggtagaagacaagaagaaaatgcagaattggttagattactaccagttgaagtatacaagaaacaaggaacaacggccacggatgggatttctcgggctatggggcaaaaaagtagatgcaatggatcattatacagcagagatcgagaaacttagcgagcaaataatggaagaaaggaagaggataaagaaagatgacaaaagtgtaatgcaagcagcttttgtgtcttttaaaacgcgttggggcgctgcggtctgcgcgcagacacaacagacgaagaatccaactgaatggttaaccgaatgggctcctgaggcaagagaaatgtactggccaaatctcgcaatgccttacgtatctctcactgtaaggagatttgtaatgcacatcgccttcttcttcctcacgttctttttcatcatcccaatcgcatttgtgcaatccttagcgagtattgaaggtatcgagaaatccgctccgttcctcagtcccattgtcaaaaacaagttaatgaaatcattgatccaaggttttcttcccggtattgtcttgaagctctttttgatattcctgccaacaatattgatgatcatgtcgaaattcgaagggtttatttcaatatcatcgttagagagaagagcggcttttcgatactatattttcaaccttgtgaatgttttcctcggtagcgtaatcactggatctgcttttgaacagctcgattcttttcttaaacaatccgcaaacgacattccgcggacagttggagtcgcgataccgataaaagcaacgttctttataacgtatataatggtagacggttgggcgggtgtggcgggagaaatctttaggctgaaaccattagtcattttccatttaaagaacttcttctttgtgaaaactgaaaaggatagagaagaagctatggatccgggacagattgatttctacgctaccgagcctcggattcaactatacttcctccttggccttgtctacgctcctgtcactcctgttcttcttcctttcatcatcttcttctttggtttcgcctacctcgtcttccgtcatcagaagtatgagagtgcgggtgcattctggccagacgttcatggacgtataatatcggcattgatcatctcacaaatccttttgttgggattaatgagcacgaaaggaaaagttcagtccacacctttcctcctcgttctagcgattctcaccttcggttttcatcggttttgcaaaggccggtacgaatcggcattcgtcattaacccgttgcaggaagctatgattaaggatacattggaacgagcaagagaaccaaacttgaatcttaaagggtttcttcagaatgcatatgttcatcctgtttttaaagacgaagaagattcagatgaagagggactaatcgaggattcagatgacgaagattgtgtagttgtacaaaccaaacgtcaaagatcacggagaaccaccgttgcgagcagcaatgcgagccgtggctcgtcacaatcaacgccttttaatcaacttgatttgggtaaggggaaaccggagacttga

SEQ ID NO: 441 - protein, 769 aa, Arabidopsis thaliana
MATLADIGLAAAINILSALIFLLLFAILRIQPFNDRVYFPKWYLKGVRSSPVNSGAFVSKIMNLDFRSYVRFLNWMPDALKMPEPELIDHAGLDSAVYLRIYLIGLKIFGPIALLSWSILVPVNWTSDGLQLAKLRNVTSSNIDKLSISNVERGSDRFWAHLVMAYAFTFWTCYVLMKEYEKIAAMRLSFLQSEKRRADQFTVLVRNVPPDSDESISENVQHFFLVNHPDHYLTHQVVYNANELAKLVEDKKKMQNWLDYYQLKYTRNKEQRPRMGFLGLWGKKVDAMDHYTAEIEKLSEQIMEERKRIKKDDKSVMQAAFVSFKTRWGAAVCAQTQQTKNPTEWLTEWAPEAREMYWPNLAMPYVSLTVRRFVMHIAFFFLTFFFIIPIAFVQSLASIEGIEKSAPFLSPIVKNKLMKSLIQGFLPGIVLKLFLIFLPTILMIMSKFEGFISISSLERRAAFRYYIFNLVNVFLGSVITGSAFEQLDSFLKQSANDIPRTVGVAIPIKATFFITYIMVDGWAGVAGEIFRLKPLVIFHLKNFFFVKTEKDREEAMDPGQIDFYATEPRIQLYFLLGLVYAPVTPVLLPFIIFFFGFAYLVFRHQKYESAGAFWPDVHGRIISALIISQILLLGLMSTKGKVQSTPFLLVLAILTFGFHRFCKGRYESAFVINPLQEAMIKDTLERAREPNLNLKGFLQNAYVHPVFKDEEDSDEEGLIEDSDDEDCVVVQTKRQRSRRTTVASSNASRGSSQSTPFNQLDLGKGKPET

SEQ ID NO: 442 - DNA, 2136 bp, Arabidopsis thaliana
atgcttttgtctgcacttcttatgtctgttgggataaactcttgcctatgtgtattactcttcattctttactctgtactgaggaagcagccacgaaactacgaggtttttttacctcgcagactcgcgaatgggacgtataaacgtagacgcaacaaagtagcaaggtatataccttctcttaaatggatttggaaatcatggagaccaacagaaaaggaacttatggaatcatctggcttggatggtgttgtgtttatgagaatgatcacttttagtttgaaagtgttcttgtttgctggtatcattggtgtttttgttctcttgcctgtgaactgctttggagatcaacttacagtgattgattacgctgactggtcagccaattctttggatctgttttctgttgcaaacctcaaagtccgctcacaatggctatgggttcactttggagctatatatcttgtgactgtatttgtttgctgtcttctttactttgaattcagatatattgcgttgaaaaggattgagcatttctattcatctaaacctaagccagaacagtttacaatattggttcgaaatatcccctcttcagatggaagcagtgtgagcgacactgttgataggttctttggtgaaaatcattcctctacctatttttctcatgtggttatccatcgaacaagtaaactccgaagtgtcgttgataaggctaaaaagttatataaagaagtgaaacataagaagccagttaaaaagacgccaatgagattcttcagtcgtaaagacaatactgagggtcactatgagagtgtgttacaggaaatggaacagaacatacgattggggcaagctgaagtttcagcacctggaaaggaagttcgagctgcttttgtatcattcaagtctcgatatggtgctgcaacagcactccacatgccacaatcaatcaaccctacttactggctcacagaaccagcaccagaacctcatgacgtacactggcctttcttctctgcatcatttatgcagaaatggcttgctaaaattctggttgtgttcgcttgtctcctccttactatcttatttcttgttccagtagtacttgtccaaggtctcaccaaccttcctgcactagaatttatgttcccgttcttgtcattgatcctatcaatgaaagttgtaagtcaaataataactggataccttccaagtcttatacttcagacatctctcaaagtcgtacctccaaccatggagtttctctcttctatccaagggcacatttgccacagcgatatacaaaagagtgcttgtaacaaggtgatctggttcactatatggaatgtgtttttcgcaactgttttctctggatcagccttctacaagctttctgtaattctcgatccaaagcaaatcccgctcaagttggctgtggctgttccagctcaggcttcgtttttcatcgcttatgttgtgacaacaggatggacagatactctgactgaactcttccgtgtagttcccttcatggtcagttacataaaaagatcttttgaaccgtcagatgaaaatgaatttgttgtaccgccaatgcggtaccacagagacactcctagagttctcttctttgggcttcttgggattacatacttcttcttagctccattgattcttcctttcatccttttatactttatccttgcatacatcatctaccgaaaccagtttatgaatgtgtatgctccaaagtttgatacgggtggaatgttttggccaatgatacactatacgatgatattctctcttgtacttatgcaagcaattgcaatcggtctatttgcgctaaagaagatggaactagctacatacttgcttgtccctcttcccgtttttactcttctctttaacgagttctgtcgtaaacgcttcatgcctatattcactgattatcctgctgaggtgttgacaaagagagataaggaagatagaaacgatccaacaatgcccgagttttacaataacttggtcagtgcgtacaaagatcctgctctgctcccacttagattctcaggatcaggaagcagaaacgatagcctcactagtcctcttctctcttttagtgaggtttga

SEQ ID NO: 443 - protein, 711 aa, Arabidopsis thaliana
MLLSALLMSVGINSCLCVLLFILYSVLRKQPRNYEVFLPRRLANGTYKRRRNKVARYIPSLKWIWKSWRPTEKELMESSGLDGVVFMRMITFSLKVFLFAGIIGVFVLLPVNCFGDQLTVIDYADWSANSLDLFSVANLKVRSQWLWVHFGAIYLVTVFVCCLLYFEFRYIALKRIEHFYSSKPKPEQFTILVRNIPSSDGSSVSDTVDRFFGENHSSTYFSHVVIHRTSKLRSVVDKAKKLYKEVKHKKPVKKTPMRFFSRKDNTEGHYESVLQEMEQNIRLGQAEVSAPGKEVRAAFVSFKSRYGAATALHMPQSINPTYWLTEPAPEPHDVHWPFFSASFMQKWLAKILVVFACLLLTILFLVPVVLVQGLTNLPALEFMFPFLSLILSMKVVSQIITGYLPSLILQTSLKVVPPTMEFLSSIQGHICHSDIQKSACNKVIWFTIWNVFFATVFSGSAFYKLSVILDPKQIPLKLAVAVPAQASFFIAYVVTTGWTDTLTELFRVVPFMVSYIKRSFEPSDENEFVVPPMRYHRDTPRVLFFGLLGITYFFLAPLILPFILLYFILAYIIYRNQFMNVYAPKFDTGGMFWPMIHYTMIFSLVLMQAIAIGLFALKKMELATYLLVPLPVFTLLFNEFCRKRFMPIFTDYPAEVLTKRDKEDRNDPTMPEFYNNLVSAYKDPALLPLRFSGSGSRNDSLTSPLLSFSEV

SEQ ID NO: 444 - DNA, 2112 bp, Arabidopsis thaliana
atgcttctgtcagcacttttaacttcagtgggaatcaatcttggcctctgttttctcttcttcactttgtattcaatattgagaaagcagcctagtaatgtcactgtatacggtccacgtcttgttaaaaaagatggcaagtctcagcagtcaaatgagttcaacctcgagaggcttttgcctactgctggttgggtcaaaagagcattggaacctaccaatgatgaaatcctctccaatcttggcttagatgctttggtcttcattcgtgtctttgtcttcagcataagagtgtttagctttgcatctgtggttgggatcttcatacttcttccagtgaattatatgggaacagagtttgaagagtttttcgacctcccaaagaagtctatggataacttcagtatctctaatgttaacgatggatcaaataagctgtggatccacttttgcgcaatatacatcttcacggcggttgtttgttctctactttactatgagcacaagtacattttaacaaagcggattgctcatctttattcatccaagcctcagccacaagaatttacagttctggtcagtggcgtccctcttgtatccgggaacagtattagtgagacagtagaaaactttttcagggaatatcattcttcctcgtatctttctcatatagttgttcatcggacagacaagttgaaagttctcatgaatgatgctgagaagctgtacaagaagcttacacgagtaaaatccggaagcatatctcgccaaaagtctaggtggggtgggtttctagggatgtttgggaataatgttgatgtggttgaccattaccaaaagaagcttgataagttagaagatgacatgagattgaaacagtctttattagcaggagaggaagttccagctgcttttgtttcctttaggacaagacatggtgctgcaatagcaacaaacattcagcaaggaatagatccaacacaatggctaactgaggcagccccggagcccgaagatgttcattggccatttttcactgcatcgtttgtgagaagatggatctccaatgtagtggtgcttgtggctttcgtagctcttttgatcctatacattgtccccgttgtattggttcaaggtcttgctaatcttcaccagttggagacttggttcccttttctaaaaggaatattaaatatgaaaatcgtgagtcaagtgattacgggatatcttccgagtctcattttccagcttttccttcttatagtaccacccattatgcttctactttcctcaatgcaaggattcatttctcatagccagattgagaaatctgcatgtatcaagcttctaatctttactgtatggaacagtttctttgcaaatgtactgtccggatctgccctttatcgtgttaatgtgttccttgaacctaagactattcctcgtgtgcttgctgcagctgtgccagcacaggcatcgttctttgtatcttatgttgtgacctctggatggactggtttatcatcagagatcctccgtttggttcctcttctttggagtttcataacgaaacttttcggcaaggaagatgacaaagaatttgaggttccttcaactcctttctgccaagaaatcccaaggattctattttttggactcctcggtataacttacttcttcctttcgccattgatactgcctttcttgttggtctactattgtcttggatatatcatctaccgcaaccagctcctaaacgtatatgcggccaagtatgaaactggtggaaagttttggccaatagttcacagctatactatcttctctttggtactaatgcacattattgcagtcggattattcgggcttaaagagcttccagtggcatcttctttaacaattccccttccggttctcacggtccttttcagcatttactgccaaagacggtttttaccaaatttcaaatcttatcctacccagtgtctggtaaacaaagataaagcagacgagagagagcaaaacatgtctgaattctattcggaactcgttgttgcttaccgagatcctgcactttcggcatcacaggactcgagagatatctcaccttga

SEQ ID NO: 445 - protein, 703 aa, Arabidopsis thaliana
MLLSALLTSVGINLGLCFLFFTLYSILRKQPSNVTVYGPRLVKKDGKSQQSNEFNLERLLPTAGWVKRALEPTNDEILSNLGLDALVFIRVFVFSIRVFSFASVVGIFILLPVNYMGTEFEEFFDLPKKSMDNFSISNVNDGSNKLWIHFCAIYIFTAVVCSLLYYEHKYILTKRIAHLYSSKPQPQEFTVLVSGVPLVSGNSISETVENFFREYHSSSYLSHIVVHRTDKLKVLMNDAEKLYKKLTRVKSGSISRQKSRWGGFLGMFGNNVDVVDHYQKKLDKLEDDMRLKQSLLAGEEVPAAFVSFRTRHGAAIATNIQQGIDPTQWLTEAAPEPEDVHWPFFTASFVRRWISNVVVLVAFVALLILYIVPVVLVQGLANLHQLETWFPFLKGILNMKIVSQVITGYLPSLIFQLFLLIVPPIMLLLSSMQGFISHSQIEKSACIKLLIFTVWNSFFANVLSGSALYRVNVFLEPKTIPRVLAAAVPAQASFFVSYVVTSGWTGLSSEILRLVPLLWSFITKLFGKEDDKEFEVPSTPFCQEIPRILFFGLLGITYFFLSPLILPFLLVYYCLGYIIYRNQLLNVYAAKYETGGKFWPIVHSYTIFSLVLMHIIAVGLFGLKELPVASSLTIPLPVLTVLFSIYCQRRFLPNFKSYPTQCLVNKDKADEREQNMSEFYSELVVAYRDPALSASQDSRDISP

SEQ ID NO: 446 - DNA, 2271 bp, Arabidopsis thaliana
atggcgacactaaccgatatcggagtcgcagcaacgatcaatattctaaccgcatttgctttcttcattgcctttgcgatacttagacttcaaccagttaacgacagagtctatttccctaaatggtatctcaagggtttaagaagtagtcctataaaaacaggtggctttgctagcaagtttgtcaatttggattttcgatcttacatcagattcttgaattggatgcctcaagctttgagaatgcctgagcctgaacttattgatcatgctggtttggattctgttgtctatctcaggatttacttactcgggttgaagatcttttttcctatagcatgtattgctttcactgtaatggtaccggttaattggactaactcgacgttggatcagttaaagaatctaacttttagtgatattgataaactctctatatcgaatataccaactggatcatccaggttttgggtgcatttgtgtatggcttatgttattaccttttggacttgctttgtcctacaacgagagtacaagcatattgcttccatgaggctacagtttcttgcttctgagcataggagacctgaccagtttactgttcttgtaaggaacattcctccagatcctgatgaatcagtaagtgagctcgttgagcatttctttaaggtcaaccatccagactactacctcacttaccaggcggtctacaacgcaaacaagctgtcggaactggtacagaagaggatgaaattgcagaattggcttgattactatcaaaacaaacactctaggaatccatctaaaaggcctttaataaagattggtttccttggctgttggggtgaagaagttgatgcaattgatcactacatagaaaaaatcgagggtctaacgagaaaaataagtgaagagaaagagacagtaatgagcagcacaaaatcactcgtacctgcagcttttgtatccttcaaaaagcgttggggcgctgttgtttgctctcaaactcaacagtctcgaaacccgacagagtggctaaccgagtgggctccagagccgcgagacatatactgggacaatctagcattaccatatgttcagctcacaatccggagactagtaatagctgtagctttcttcttcctcactttcttcttcatgatccctatagctttcgtacagacactcgccaatatcgaaggcatcgaaaaggctgttccgttcttgaaaccgcttatcgaagtgaaaactgtaaagtcatttatccaaggttttcttccgggtatcgcattgaagatattcctcattgtcctcccaagtatactaatgctaatgtcgaagttcgaaggcttcataagcaaatcttcactagaaagaaggtgtgcaagcagatactacatgttccagttcatcaacgttttcctctgtagcataatcgcgggaactgcgcttcaacaacttgacagcttcctaaaccaatctgcaaccgaaataccgaagacaattggtgtctcgataccaatgaaagccactttctttatcacctacataatggtagacggatgggctggtgttgctggagagatactgaggttaaagccattgataatatatcatctcaagaacttcttccttgtgaaaacagagaaggacagagaagaagcaatggatcctggaaccataggtttcaatactggtgaacctcagatacaactctacttcattcttggtctagtttacgccgctgttagccccattctccttccttttatcctcgtcttcttcgccttagcttacgtggtttaccgtcatcagattataaatgtgtataaccaagagtatgagagtgctgcagcgttctggccagatgttcatagacgtgtagtgattgcactgatcgtatctcagcttcttttgatgggattgcttagcacgaaaaaagctgctcgttcgactccattgcttttcatacttcctgtgttaaccattggattccacaaattctgtcaaggacgttaccaacctatatttgtcacataccctttacaggatgcaatggttaaagatacgttggaacgcatgagagaaccgaatttaaacttgaaaacgtttcttcaaaacgcgtatgcacatccggtgtttaaagctgcagataatctagctaatgagatggttgtggaggagccagcgcccgataagacgccggatttagtggcgactaaacgtggctcaaggaggtttaatagcggctctgctgaaacctttacttag

SEQ ID NO: 447 - protein, 756 aa, Arabidopsis thaliana
MATLTDIGVAATINILTAFAFFIAFAILRLQPVNDRVYFPKWYLKGLRSSPIKTGGFASKFVNLDFRSYIRFLNWMPQALRMPEPELIDHAGLDSVVYLRIYLLGLKIFFPIACIAFTVMVPVNWTNSTLDQLKNLTFSDIDKLSISNIPTGSSRFWVHLCMAYVITFWTCFVLQREYKHIASMRLQFLASEHRRPDQFTVLVRNIPPDPDESVSELVEHFFKVNHPDYYLTYQAVYNANKLSELVQKRMKLQNWLDYYQNKHSRNPSKRPLIKIGFLGCWGEEVDAIDHYIEKIEGLTRKISEEKETVMSSTKSLVPAAFVSFKKRWGAVVCSQTQQSRNPTEWLTEWAPEPRDIYWDNLALPYVQLTIRRLVIAVAFFFLTFFFMIPIAFVQTLANIEGIEKAVPFLKPLIEVKTVKSFIQGFLPGIALKIFLIVLPSILMLMSKFEGFISKSSLERRCASRYYMFQFINVFLCSIIAGTALQQLDSFLNQSATEIPKTIGVSIPMKATFFITYIMVDGWAGVAGEILRLKPLIIYHLKNFFLVKTEKDREEAMDPGTIGFNTGEPQIQLYFILGLVYAAVSPILLPFILVFFALAYVVYRHQIINVYNQEYESAAAFWPDVHRRVVIALIVSQLLLMGLLSTKKAARSTPLLFILPVLTIGFHKFCQGRYQPIFVTYPLQDAMVKDTLERMREPNLNLKTFLQNAYAHPVFKAADNLANEMVVEEPAPDKTPDLVATKRGSRRFNSGSAETFT

SEQ ID NO: 448 - DNA, 1854 bp, Arabidopsis thaliana
atgtgcagaattagattcttcctgatgtgttcgttacttggagcatcactacttcttccggttgattattacaatgagtcagatttaccgacacgaagagagtattcaatggatgctttcacaatatcaaatatcacacgaggttctaacaagttatgggtgcatttctcatgcttgtggtgcatatcattctatgcattgtttttgttgcataaggaatataaggagattcttgtgataaggcttcaacaaatgaaagaacttagacatcgtgctgatcagttcactgttcttgtccgccaagttcctctctgccctgagcataacactcgtggctgcgccgttgatcactttttctctaagcatcatcgctttagttatcattcacatcagatgttgtatgacgggagagatcttgaataccttttggggaagcagaagaagcttaagaaagagctagaagacaagagacacacagaaatactttcaaatggatcacaagaacacaagcaaatatccacatctgaagaaaaacttcgagaaattactcatatgatttaccaccttcaaagtgaaactatgctcagagagaaggagttacctgttgcgtttgtcaccttcaaatcccgaagaaatgccgcgttggcagctcaaacacagcagcactcaaatcctctagaactgataactgaaatggctcctgaaccaagagatgtatcctggagaaatcttgctattccacaaaagattttgcctctcaacaagatcggagtcatccttgcagcagcacttcttacaatcttctttgctattccggtcacagctgtccagggaattgcaaagtatgagaagcttaagaaatggtttcctccagccatggctattgaattcataccagggcttagctcagttgtgacaggttacctcccaagtgctatactcaaaggtttcatgtacattattcctttcgctatgcttggactggcctatctcggcggctctatttccaacagtaaagaggagataaaagcttgcaacatggtcttctattttctaatgggaaatgttttcttcttgagtcttatctctggttccttgcttgatgaaataggagaatatctcactcatcctagagacattcctagtcaccttgctgctgctgtttcagcccaggcagagttttttatgacatacatcttgacagatgggctgtctggattttctttggagattcttcaattgggacttatactatttgatatcataagatcatacacttatggaagaggaaaagagagaactccttacctcttttcatttccatattttagagttatccccacagtttccttatcgataatgatcggtatgatttatgcggtggttgcgccattgatgctccctttcctagttggttatttctgccttggatacattgtctacttcaatcagatggaggatgtttacgagactacatatgatacttgcggtcgattctggccattcattcatcattatatatttgtctcaataatactaatgcaaatcacaatggtgggtctttttggacttaaatcaaagccatctgcagcaattgctacagtacctctcatattgatcactatagcttataacgaatactgcaagatccgcttcctcccatcatttaaacatttccctatacagacagcagttgaaatagacgaagaagatgaaaagaatggggagatggaaacacattatgttgatgctgcaacggcgtataaccggcatcaaccttgcttagagcgtgtaagctcagcggaatcaccaacaaacttaagccaaccattgcttgggacagactccatttga

SEQ ID NO: 449 - protein, 617 aa, Arabidopsis thaliana
MCRIRFFLMCSLLGASLLLPVDYYNESDLPTRREYSMDAFTISNITRGSNKLWVHFSCLWCISFYALFLLHKEYKEILVIRLQQMKELRHRADQFTVLVRQVPLCPEHNTRGCAVDHFFSKHHRFSYHSHQMLYDGRDLEYLLGKQKKLKKELEDKRHTEILSNGSQEHKQISTSEEKLREITHMIYHLQSETMLREKELPVAFVTFKSRRNAALAAQTQQHSNPLELITEMAPEPRDVSWRNLAIPQKILPLNKIGVILAAALLTIFFAIPVTAVQGIAKYEKLKKWFPPAMAIEFIPGLSSVVTGYLPSAILKGFMYIIPFAMLGLAYLGGSISNSKEEIKACNMVFYFLMGNVFFLSLISGSLLDEIGEYLTHPRDIPSHLAAAVSAQAEFFMTYILTDGLSGFSLEILQLGLILFDIIRSYTYGRGKERTPYLFSFPYFRVIPTVSLSIMIGMIYAVVAPLMLPFLVGYFCLGYIVYFNQMEDVYETTYDTCGRFWPFIHHYIFVSIILMQITMVGLFGLKSKPSAAIATVPLILITIAYNEYCKIRFLPSFKHFPIQTAVEIDEEDEKNGEMETHYVDAATAYNRHQPCLERVSSAESPTNLSQPLLGTDSI

SEQ ID NO: 450 - DNA, 2358 bp, Arabidopsis thaliana
atggcttcagtacaagatattggtctatcagcagctataaatctattatctgcatttgctttcttgtttgcatttgctatgcttagacttcagccagttaacgatagagtttacttcccaaaatggtatctcaaagggataagaggaagtccaacgcgttctagaggaatcatgactagatttgttaatttagattggactacttatgtcaagtttcttaattggatgcctgctgctcttcaaatgcctgaacctgagcttatagaacatgcaggccttgactctgctgtatatatccgcatttaccttcttggattgaaaatgttcgttccgataacactacttgcttttggagttttggttcctgtcaattggactggagaaactctagaaaatatcgatgacttgacattcagtaacgtcgataagctgtcaatatcaaatgttccaccaggatcgccgaggttttgggcacatataactatgacatacgtgattacattctggacttgctacatattatatatggaatataaggctgtggctaatatgagattgagacatctagcagcagaaagtcgtcgtcctgatcaactcactgtacttgtaagaaatgttcctccagatcctgatgaatcagtaaacgagcatgttgagcacttcttttgtgtaaatcatccagatcattatctttgccatcaggtagtgtacaatgcaaatgaccttgcaaaattagtcgcacagagaaaagctatgcaaaattggttgacgtactacgagaataaattcgagaggaagccatcaagtagaccaacaacaaagacaggttatggaggtttttggggaactacagttgatgcaattgacttctacacttcaaagatggatattctggctgagcaagaagctgtagaaagagaaaagatcatgaacgatcctaaggctatcatgccggcagcatttgtttccttcagatcacggtggggaacagctgtttgtgctcaaacacagcaatgccacaatcccacaatctggttgacggaatgggctcccgaaccacgcgatgttttctgggataatctcgctattccatatgttgagctctcaataagaagattgctcacaacagttgcactgttttttcttattttctgcttcatgattcctatagcatttgttcagtctcttgccaaccttgaagggatccaaaaagttctccctttcttgaaacccgtgatagaaatgaagactgtaaagtctgtaatccaagggtttcttccaggaatagcgttaaagatttttctcatcatacttccaactattctgatgacaatgtcacaaattgaaggatatacatcgctgtcctatttagatagaagatcagctgaaaagtatttctggttcattattgtcaatgtctttcttggaagcatcattaccgggacagcgtttcagcagcttaaatctttccttgagcaaccaccaaccgagatcccgaaaacagttggtgtgtcaatcccaatgaaggccacatttttcatcacatatatcatggtcgatggttgggctggcatagcagctgagatactcagagtggttccattagtcatctttcacctgaaaaacacgtttttggttaagacagaacaagacaggcagcaagcaatggatccaggtcatctggactttgcaacatctgaaccacggattcagttctatttcttgctaggcctcgtatacgctgctgttgcgccaattctccttccattcattatcgtcttctttgctttcgcatacgttgtttttcggcatcaggttattaatgtctacgaccagaaatatgagagcggggctagatactggcctgacgtgcatagacgtttgatcatatgtctaataatatcacagcttctgatgatgggtctgctcagcacaaagaaatttgcaaaagtaacagctctgcttctccctcagcctatcttaaccttttggttttacagatactgcgcaggacggtttgaatcggccttctcaaaatttcctttacaggaagcaatggtgaaggatacactagaaaaagcaactgaaccgaatctaaacctcaaggaatatctgaaagatgcttacgtgcatccggtttttaaaggcaatgattttgaccgaccacgggtagtcgatgaggaggaaagtaaccctcttgtaaggaccaagaggacttctcaaggtacgacccgatacaactcagaagctagtagctctgctacaaccactcctgtagccaacaatgactctcctagatgttggggtacaaaaattgggtcctttggatgtgtaattgttgtttcatacagttgttag

SEQ ID NO: 451 - protein, 785 aa, Arabidopsis thaliana
MASVQDIGLSAAINLLSAFAFLFAFAMLRLQPVNDRVYFPKWYLKGIRGSPTRSRGIMTRFVNLDWTTYVKFLNWMPAALQMPEPELIEHAGLDSAVYIRIYLLGLKMFVPITLLAFGVLVPVNWTGETLENIDDLTFSNVDKLSISNVPPGSPRFWAHITMTYVITFWTCYILYMEYKAVANMRLRHLAAESRRPDQLTVLVRNVPPDPDESVNEHVEHFFCVNHPDHYLCHQVVYNANDLAKLVAQRKAMQNWLTYYENKFERKPSSRPTTKTGYGGFWGTTVDAIDFYTSKMDILAEQEAVEREKIMNDPKAIMPAAFVSFRSRWGTAVCAQTQQCHNPTIWLTEWAPEPRDVFWDNLAIPYVELSIRRLLTTVALFFLIFCFMIPIAFVQSLANLEGIQKVLPFLKPVIEMKTVKSVIQGFLPGIALKIFLIILPTILMTMSQIEGYTSLSYLDRRSAEKYFWFIIVNVFLGSIITGTAFQQLKSFLEQPPTEIPKTVGVSIPMKATFFITYIMVDGWAGIAAEILRVVPLVIFHLKNTFLVKTEQDRQQAMDPGHLDFATSEPRIQFYFLLGLVYAAVAPILLPFIIVFFAFAYVVFRHQVINVYDQKYESGARYWPDVHRRLIICLIISQLLMMGLLSTKKFAKVTALLLPQPILTFWFYRYCAGRFESAFSKFPLQEAMVKDTLEKATEPNLNLKEYLKDAYVHPVFKGNDFDRPRVVDEEESNPLVRTKRTSQGTTRYNSEASSSATTTPVANNDSPRCWGTKIGSFGCVIVVSYSC

SEQ ID NO: 452 - DNA, 2319 bp, Arabidopsis thaliana
atggcaacacttaaagacattggtgtatcagcagggataaacatcctcactgcattcattttcttcataatctttgcgtttttaaggcttcagccattcaacgacagagtttacttctccaaatggtacctcagggggttaagaagcagccctgcaagtggcggcggattcgcggggcggtttgtgaatttggagttgagatcatacctcaagttcttgcattggatgcctgaagctcttaagatgcctgagcgtgagctgattgatcatgctggtttagactctgttgtctatctccggatttactggctcgggcttaagatttttgctccaatagcaatgcttgcttgggcagttcttgtaccggttaattggacaaacaacgagttggagttggctaagcattttaagaatgtgacttcaagtgatattgacaaactaacaatttcgaatatcccagaaggttcaaataggttttgggctcatatcataatggcttatgcctttacaatctggacttgttatatgctgatgaaggagtatgagacagttgctaacatgaggcttcagtttcttgcctcagaaggccgtcgacctgaccagttcactgttcttgttaggaatgtacctccggacccagacgaaactgtgagtgagcttgtggagcattttttcctagttaatcaccctgataactacctcacacatcaggttgtatgcaatgcaaacaagctcgcggatttggttagtaaaaagacgaagctgcagaactggcttgactattatcagctcaaatacactagaaataattctcagatcagacctataacgaagcttgggtgccttggcttgtgtggacaaaaagttgacgcaatcgaacattacattgctgaagtagataaaacatcaaaagagattgctgaagagagagagaatgtggtgaatgatcaaaagtcagtcatgccagcatcttttgtctctttcaaaacccgttgggctgctgctgtttgcgctcagaccacgcagacccgaaacccaactgaatggttaaccgaatgggctgcagagccgcgtgatatatattggccaaacctagcgattccatatgtttctttgactgtgagaagattggttatgaatgtagccttcttcttccttaccttctttttcatcatccctatcgcgtttgtacaatctcttgctaccattgaaggaattgagaaagttgcaccgttcttgaaagtcattatcgaaaaagatttcataaaatcgctgatacaaggtttgctagccggtattgcgttgaagcttttcctcatctttctgccagccatactgatgaccatgtccaaatttgaaggctttacttcagtttcattcttagaaagacgatccgcgtctagatattacatctttaacttagtgaacgtctttcttggaagtgttatcgctggagctgcgtttgagcagcttaactctttcctcaatcaatcgcctaatcaaatccctaagactattggcatggcgataccgatgaaagcaaccttctttatcacatatataatggttgatggttgggcaggagttgcaggagagattcttatgttgaaacctctcattatataccacctcaaaaacgcattcttggtgaaaacagagaaagacagagaggaagcaatgaacccgggaagcatcggtttcaacactggagagcctcagatacagctttacttccttcttggtcttgtctatgctcctgtgacaccaatgcttcttccttttatcttagtctttttcgctcttgcttatgtcgtataccgccatcagatcataaatgtgtataatcaagagtatgagagcgctgctgcgttttggccggatgttcatggacgggttataacggcattgatcatatctcagttgcttctgatgggtttgttaggtacaaaacatgccgcttcagctgctccgtttctcattgctcttcctgtgattactatcggtttccaccgcttctgtaaaggccgtttcgaacctgcctttgtccgttaccccttacaggaagctatgatgaaagatacattggaaagagcaagagagccaaatctgaacctgaaaggttacttgcaagacgcttatattcatccggtttttaaaggcggtgataatgatgacgacggtgacatgatcggaaaattggagaatgaagtcatcatagtgccaacaaaacgccaatcgcggaggaacactcctgcaccgagcagaatcagcggtgaatcgtctccatctttggccgttattaacggtaaagaagtctag

SEQ ID NO: 453 - protein, 772 aa, Arabidopsis thaliana
MATLKDIGVSAGINILTAFIFFIIFAFLRLQPFNDRVYFSKWYLRGLRSSPASGGGFAGRFVNLELRSYLKFLHWMPEALKMPERELIDHAGLDSVVYLRIYWLGLKIFAPIAMLAWAVLVPVNWTNNELELAKHFKNVTSSDIDKLTISNIPEGSNRFWAHIIMAYAFTIWTCYMLMKEYETVANMRLQFLASEGRRPDQFTVLVRNVPPDPDETVSELVEHFFLVNHPDNYLTHQVVCNANKLADLVSKKTKLQNWLDYYQLKYTRNNSQIRPITKLGCLGLCGQKVDAIEHYIAEVDKTSKEIAEERENVVNDQKSVMPASFVSFKTRWAAAVCAQTTQTRNPTEWLTEWAAEPRDIYWPNLAIPYVSLTVRRLVMNVAFFFLTFFFIIPIAFVQSLATIEGIEKVAPFLKVIIEKDFIKSLIQGLLAGIALKLFLIFLPAILMTMSKFEGFTSVSFLERRSASRYYIFNLVNVFLGSVIAGAAFEQLNSFLNQSPNQIPKTIGMAIPMKATFFITYIMVDGWAGVAGEILMLKPLIIYHLKNAFLVKTEKDREEAMNPGSIGFNTGEPQIQLYFLLGLVYAPVTPMLLPFILVFFALAYVVYRHQIINVYNQEYESAAAFWPDVHGRVITALIISQLLLMGLLGTKHAASAAPFLIALPVITIGFHRFCKGRFEPAFVRYPLQEAMMKDTLERAREPNLNLKGYLQDAYIHPVFKGGDNDDDGDMIGKLENEVIIVPTKRQSRRNTPAPSRISGESSPSLAVINGKEV

SEQ ID NO: 454 - DNA, 2286 bp, Arabidopsis thaliana
atggctacaataaacgatattggagtagcagcagcaatcaatatagtcacagcatttgcttttctcttagcttttgctatattcaggattcaaccagtaaatgacagagtctatttccctaaatggtatctcaagggcttaagaagtagttctatacaaactggtggctttggtagcaaattcatcaatttggacttcaggtcctatattcgtttcctcaattggatgcctgaagcacttaaaatgccagaaccggaactcgtcgatcacgctggactcgattctgttgtctacttgaggatctacttactcgggctcaagatctttttccctatagcttgtgttgcttttacaacaatggttcctgttaattggacaaacaaaggattggatcggttaaggcattccaatataagtttcagtgatattgataaactctctttatcaaatataccaaatgggtcacctagattttgggtgcatttgtgtatggcttatgcgattaccttctggacatgctttatcctgaaaagagagtaccagaatatagctttaatgagactacagtttcttgcaaatgatcaaaggagacctaaccagttcactgtactggtaagaaacattcctgcagatcctcatgaatcaatatgtgaacttgttgaacatttcttcaaagtcaatcatccagatcactatctcactttccaggcagtccacgatgcaaccaaactctcggaattggttctgacgaggaaacaaatgcagaacctgcttgattacaatataaacaaacacatgaggaatctatctaacaggccagtaataaagatgggatttcttggctgctgtggtgaagaagctgatggaatcaaatattacacgtccgtcgttgagggtctaacaagagaaatatctgaggagaaacagaggttaaggaccggcacaaagtccatagtgcctgcagcttttgtatctttcaagagccgttggggagcagcggtttgtgctcaaactcaacagacaagaaacccaacagaatggctaactgagtgggctgcagagccacgtgacatctactatgacaatctggcattgccatatgtagaccttaagataaggaggctcatagtcggcgtcgcatacttcttcctcaccttcttcttcatgataccaatagcatttgtacagtcactcgccaacatcgaaggcatagagaaggcttttcctttcttgaagccccttatagaagtgaaattgttaaagtcgatcatccaaggtttccttcccggaatcgccttgaagatcttcctccttttcctcccaagaatactcatgcagatgtccaaatttgaaggttttgtcagcacatcctcattagaaagaagagctgcaactagattctacatgttccaattcatcaatgttttccttggaagcatagtcaccgggactgcgtttcaacagctcaacagtttccttaaccagtctgcaaacgatattccaaaaacaattggtgtctcgattccaatgaaagcgaccttctttataacatacataatggtggatggatgggctggtgttgctggtgagatattgaggttgaagccactcataatctatcatctaaagaactccttcctcgtgagaaccgaaaaagatagggaagaagcaactgatcctggaaccataggattcaacactggtgagcctcaaatacaactctacttccttcttggtcttgtttacgcagcagttagccccatccttctcccttttatcctcgtcttcttcggcctggcttttgtagtgtaccgtcatcaggttataaatgtgtataaccaaaagtatgagagcgcagggaagttctggcctgacgttcacaggcgtgttgtgaccgcattggttgtttcacagctgctcttgatgggtcttctaagcaccaaacacgcttctaagtccactcctttgctgcttgtgcttccgttgctgaccatcgggttccacaaacactgcaaaaaccgttaccaacctgcctttgtcacatacccgttacagcaggaagccatgatcaaagatacactggaccgtatacgtgaaccaaacttaaacctcaaagctttccttcgagacgcctacgcccacccggagttcagggttggagaagatccagagcccgaggagaagctggagtctgatatgtcacctccggatttagtggccactaagcgttggtcatggaggaacactcctttgcctagcaaagatagctgccgtgaaataccctaa

SEQ ID NO: 455 - protein, 761 aa, Arabidopsis thaliana
MATINDIGVAAAINIVTAFAFLLAFAIFRIQPVNDRVYFPKWYLKGLRSSSIQTGGFGSKFINLDFRSYIRFLNWMPEALKMPEPELVDHAGLDSVVYLRIYLLGLKIFFPIACVAFTTMVPVNWTNKGLDRLRHSNISFSDIDKLSLSNIPNGSPRFWVHLCMAYAITFWTCFILKREYQNIALMRLQFLANDQRRPNQFTVLVRNIPADPHESICELVEHFFKVNHPDHYLTFQAVHDATKLSELVLTRKQMQNLLDYNINKHMRNLSNRPVIKMGFLGCCGEEADGIKYYTSVVEGLTREISEEKQRLRTGTKSIVPAAFVSFKSRWGAAVCAQTQQTRNPTEWLTEWAAEPRDIYYDNLALPYVDLKIRRLIVGVAYFFLTFFFMIPIAFVQSLANIEGIEKAFPFLKPLIEVKLLKSIIQGFLPGIALKIFLLFLPRILMQMSKFEGFVSTSSLERRAATRFYMFQFINVFLGSIVTGTAFQQLNSFLNQSANDIPKTIGVSIPMKATFFITYIMVDGWAGVAGEILRLKPLIIYHLKNSFLVRTEKDREEATDPGTIGFNTGEPQIQLYFLLGLVYAAVSPILLPFILVFFGLAFVVYRHQVINVYNQKYESAGKFWPDVHRRVVTALVVSQLLLMGLLSTKHASKSTPLLLVLPLLTIGFHKHCKNRYQPAFVTYPLQQEAMIKDTLDRIREPNLNLKAFLRDAYAHPEFRVGEDPEPEEKLESDMSPPDLVATKRWSWRNTPLPSKDSCREIP

SEQ ID NO: 456 - DNA, 2316 bp, Arabidopsis thaliana
atggcgacacttcaggatattggtgtatcagctgggataaacattctcagtgcctttgttttcttcataatctttgcggttttgaggcttcagcctttcaatgatagagtttacttctcaaaatggtatctcaaggggttaagaagcagccctgctcgtggtggcgcctttgcgcagaggtttgtgaacctggacttcaggtcttatatgaagttcttgaattggatgccagaggctctgaagatgcctgagcctgagcttattgatcatgctggtttggattcagttgtttatctccggatttactggctggggcttaagatctttactccaatagcagtgcttgcttgggcagttcttgtgccagtcaactggactaataacacattggagatggctaagcagttaaggaatgtaacttcgagcgacattgacaaactctctgtttcaaatattccagagtattcaatgaggttttggactcatatagtaatggcttatgcctttaccatctggacttgttatgtgctgatgaaagaatatgagacaattgctaacatgaggctccagtttgttgcatcagaagctcgtcgacctgaccagttcactgtccttgttaggaatgtacctccggacgcagatgaatctgtaagtgaactggtagagcattttttcctggtcaatcatcctgatcactacctaacacatcaggttgtatgcaatgcaaacaagctggccgatttggtgaaaaagaagaaaaagctgcagaattggcttgattactaccagctcaaatacgctaggaataactctcagagaattatggtgaagcttggctttcttgggctatggggacaaaaagtcgatgccattgaacattacattgctgaaattgacaaaatatcaaaagagatcagtaaagaaagagaggaagtggtgaatgatcctaaggccattatgccagcagcgtttgtctcctttaaaacacgatgggctgctgcggtttgtgctcagactcaacagacccgaaacccaacccaatggctgaccgaatgggctccagaaccgcgtgatgtgttttggtcaaatcttgctattccatatgtttctctgacagtaaggaggttgatcatgcatgttgccttcttcttcctaaccttcttcttcattgtccccatcgcgtttgttcaatctcttgctaccattgaagggattgtgaaagctgctccgttcttgaagtttattgtagatgataaattcatgaaatcggtgatacaaggtttccttccgggtattgcactgaagcttttcctcgcctttctgccatccattttgatgatcatgtccaaatttgaaggcttcacatcgatctcatctttagagagacgagcagcgtttcgatattacatcttcaacttagtgaacgtctttcttgctagcgttatcgctggagctgcgtttgaacagcttaactctttcctcaatcaatccgcaaaccaaatccccaaaaccattggtgtggcgataccgatgaaagcaactttcttcatcacgtatataatggttgatggttgggcaggagttgcaggagagattctaatgctgaaaccattgattatgttccatctcaaaaacgccttcttggttaagactgataaagacagagaggaagcaatggacccgggaagcattggttttaacacgggtgagcctcggatacagctctactttcttctcggtcttgtctacgctcctgtgacaccgatgcttcttccttttatcttggtcttcttcgcccttgcttacattgtatatcgccaccaaatcattaacgtatacaatcaagaatacgagagtgctgcagcgttttggccagacgttcatggacgagtcatagcagcattggtaatatcacagttgcttctgatgggtctattgggaacaaagcacgctgcattagctgcaccgtttctcattgctttgcctgtgcttaccattggtttccaccacttctgcaaaggtcgttatgagccagctttcatcagataccctttacaggaagctatgatgaaagatacattagaaaccgcaagagaaccaaacctgaaccttaaaggctacttgcaaaatgcttacgttcatccggttttcaaaggcgatgaagacgattatgacattgatgacaagctcgggaagtttgaggatgaagccattattgttcccaccaaacgtcagtcgaggagaaatactccggctcctagcataatcagtggggacgattcgccgtctttgccctttagtggtaaactagtctaa

SEQ ID NO: 457 - protein, 771 aa, Arabidopsis thaliana
MATLQDIGVSAGINILSAFVFFIIFAVLRLQPFNDRVYFSKWYLKGLRSSPARGGAFAQRFVNLDFRSYMKFLNWMPEALKMPEPELIDHAGLDSVVYLRIYWLGLKIFTPIAVLAWAVLVPVNWTNNTLEMAKQLRNVTSSDIDKLSVSNIPEYSMRFWTHIVMAYAFTIWTCYVLMKEYETIANMRLQFVASEARRPDQFTVLVRNVPPDADESVSELVEHFFLVNHPDHYLTHQVVCNANKLADLVKKKKKLQNWLDYYQLKYARNNSQRIMVKLGFLGLWGQKVDAIEHYIAEIDKISKEISKEREEVVNDPKAIMPAAFVSFKTRWAAAVCAQTQQTRNPTQWLTEWAPEPRDVFWSNLAIPYVSLTVRRLIMHVAFFFLTFFFIVPIAFVQSLATIEGIVKAAPFLKFIVDDKFMKSVIQGFLPGIALKLFLAFLPSILMIMSKFEGFTSISSLERRAAFRYYIFNLVNVFLASVIAGAAFEQLNSFLNQSANQIPKTIGVAIPMKATFFITYIMVDGWAGVAGEILMLKPLIMFHLKNAFLVKTDKDREEAMDPGSIGFNTGEPRIQLYFLLGLVYAPVTPMLLPFILVFFALAYIVYRHQIINVYNQEYESAAAFWPDVHGRVIAALVISQLLLMGLLGTKHAALAAPFLIALPVLTIGFHHFCKGRYEPAFIRYPLQEAMMKDTLETAREPNLNLKGYLQNAYVHPVFKGDEDDYDIDDKLGKFEDEAIIVPTKRQSRRNTPAPSIISGDDSPSLPFSGKLV

SEQ ID NO: 458 - DNA, 2454 bp, Arabidopsis thaliana
atgaatcgcaatttttcaccagctgcgatgccaccgatttcatcaatgacaatagataattcattctctcctcctccatcttccggcgacttacctgaaatcccagatgcttggtacggcaacattcagtatctgcttaatatctcggtcattggtctcttatgctgcgtctccatctttctcttcgttaagctacgcagcgaccaccgtcgtatgcctggtccttctgctctcttctctaagctcctcgccgtttggaaagccacgtgtcgcgagatcgctcgtcactgtggtgctgatgctgctcagtttcttttaattgaaggtggaagctttgtgcttcttttctccattgctgttttagctgtttcggttatgcttccgttgaatttatatgctgggactgctttgttgagtgatgagctttcgaaaacgatgattacgcatattcagaaaggttcagctttgctttggctgcattttgtgtttgttgttattgttgttgttatctcgcattttggaatcgctgctattgaagctaggttgaagtttactaggtttagagatgggaatgggaatatcagtgacccgaacgcgaattctactgctgtgtttactataatggtgcagggtttgcctaagaatttagggtctgatagagttgagtttgaagattgctttaggctgaagtaccctgggaaagtttataagtttattgttcccatggatttgtgtgctttggatgatcttgctacagagttggttcgtgttcgagatgagattacttggttagttgccaagatggactctaggcttctaccggatgagtatgagaatgttggagataacggactagtgttctgtgtgtgttctttgtgggttagggtgaaggttttgtggtctcagattacagagaggtttggatttacagatgatgaaaaactgaggaagctgcaagaactgagagctgatttggagtctcagttagcagcttataaagaaggacgagcacaaggcgctggggttgcttttgtgatgtttaaggatgtgtacacagctaataaggctgttcaggattttcgaaacgagagatcaaggcgtactggaaagttcttctctgtcacagagctgcgattacagagaaaccagtggaaagtggacagagcacccttggctactgatatttattggaatcatctgggattgacaaaagttgctcttattgtgcgaagagtgattgttaatactattctactgttgattcttgtgtttttcagctccccattggccttgatcagtgcattggtaagtgccgggagaatcttcaatgctgaagcattggatagtgctcagtattggctcacttgggtgcaaacttctggctggattggatctctgatttttcagttcctgcccaacgtcttcatatttgttagtatgtacattgtaatcccttctgcgctctcgtatctttccaagtttgagcggcatctaacagtgtctggggaacaaagagcagctctcttgaagatggtttgcttcttccttgtgaacctcatcattctcaaggctcttgtggagtcgtcactggaaagtgcactcctgaaaatgagccgttgctatttagatggtgaggattgcaagaggattgaagaatacatgagcccttccttcttatcaaggtcatgcgtttcagctctagcttttctcatcacaagcacgttcctaggaatctccttcgatctactcgctccaatcccgtggatcaagaagaaaattcaaaagttcaggaagaatgacatgcttcagcttgtccccgagcaaaatgaagagtacgctttggaaaatcaagagccaagcagtaaccttgagacaccacttctccctgaaaacatgtttgagtctccaagattcggggacatagaacctatgagccaagacctctctgaatacccaatcagccgaacctcaccaatccctaaacagaaattcgactttgcccaatactacgccttcaatctcaccatctttgccttaacaatgatatactcttcattcgctccactcgtggtccctgtaggcgcagtttactttggttacagatacattgtcgacaaatacaacttcctttacgtgtacagagtccgtggcttccctgcagggaatgaaggaaagctaatggacacggttttgtgtatcatgagattctgtgtcgacctgtacctcgtctcaatgctgctcttcttctcagttaaaggagattccacaaagcttcaagccatattcacacttggagtgcttgtgatgtacaagcttttgccttcggatacagaccggtatcacccagctttactaagaagtattcagaccgtcgatagcatcatcgacggacctgtggattacgaagcttattctcacccaaacttcgattgggacacttacaacaacagatga

SEQ ID NO: 459 - protein, 817 aa, Arabidopsis thaliana
MNRNFSPAAMPPISSMTIDNSFSPPPSSGDLPEIPDAWYGNIQYLLNISVIGLLCCVSIFLFVKLRSDHRRMPGPSALFSKLLAVWKATCREIARHCGADAAQFLLIEGGSFVLLFSIAVLAVSVMLPLNLYAGTALLSDELSKTMITHIQKGSALLWLHFVFVVIVVVISHFGIAAIEARLKFTRFRDGNGNISDPNANSTAVFTIMVQGLPKNLGSDRVEFEDCFRLKYPGKVYKFIVPMDLCALDDLATELVRVRDEITWLVAKMDSRLLPDEYENVGDNGLVFCVCSLWVRVKVLWSQITERFGFTDDEKLRKLQELRADLESQLAAYKEGRAQGAGVAFVMFKDVYTANKAVQDFRNERSRRTGKFFSVTELRLQRNQWKVDRAPLATDIYWNHLGLTKVALIVRRVIVNTILLLILVFFSSPLALISALVSAGRIFNAEALDSAQYWLTWVQTSGWIGSLIFQFLPNVFIFVSMYIVIPSALSYLSKFERHLTVSGEQRAALLKMVCFFLVNLIILKALVESSLESALLKMSRCYLDGEDCKRIEEYMSPSFLSRSCVSALAFLITSTFLGISFDLLAPIPWIKKKIQKFRKNDMLQLVPEQNEEYALENQEPSSNLETPLLPENMFESPRFGDIEPMSQDLSEYPISRTSPIPKQKFDFAQYYAFNLTIFALTMIYSSFAPLVVPVGAVYFGYRYIVDKYNFLYVYRVRGFPAGNEGKLMDTVLCIMRFCVDLYLVSMLLFFSVKGDSTKLQAIFTLGVLVMYKLLPSDTDRYHPALLRSIQTVDSIIDGPVDYEAYSHPNFDWDTYNNR

SEQ ID NO: 460 - DNA, 2363 bp, Aquilegia spp.
tgccaatcatcagtcacgtcattaagactaacgctactatataaccattataagctccacaattatctcttccatgaagaaaaaagatggatttgagttcatttttagcatcattaacaacatcatttttagtatttgtgattttaatgttggtttttacttggctttctagaaaacctggaaatagtgtgatttattatccaaatagaattgttaaaggtttaaaaccttatgaaggtgttagaacaagaagtccatttgcttggattaaagaaagtattacttctactgaagatgatattatctccatttctggtgttgatactgctgtttactttgtcttcttgtcaacagttttggggatattggtttcatctggtacacttttactaccgtctcttttgcctattgctggaactgcaaaaggcgatgccaagaacaatagtaacttcaccagccttgaaaggatttccatggcaaatgttgaggagaaaagtccgagattgtgggcttttcttttagccacatatgtggtgtctttttccacattgtatatgttatggaaagcctatattcatgtttctgagctaagaagcacagctctaagtgctccggacgtgaagccagagcaatatgcgattctagtcagagacataccagctgttccggagggacagacccggaaagaacaggttgattcatatttcagcttactccatggagatacattttacagatcaatggtggtgacagacaacatagaggtgaacaaaatttgggaagatttggaaaactatagaaagaaacgtgcccgtgctgaagccatacttgaagcttctaaaacaagacctatgaacaaaacgggttttctcagcggtgacaaagttaatacaataaaacattgcacagaaatgattcatgaactggtacccaaattaaaaatagaacaggaaaataccattagagaaaaacagcaatcttcggctttgatcttcttcacgaacaggatagctgcaacatctgctgcccagaccatccatgcgaagaaggttgatacatggacagtggtagaagctcctgaaccacgacagataatatggaggaatcttaaaatgaagttctatcaaaggaagctcaaaaaggatattgtttttgtcatagttgcgttgactatattcttttacatgatcccaattgcgtttatctctgcttttacaactatgaagaatctgaagaagcttctgcctttcatgaagccaattgtggaccagccacaggttaagacagtgttggaagcatacttgcctcagattgcactcattgttttcctggcgttgattccaaagattcttatgttcctctccaagactgagggcccttcaataagctatgtcgtaagggcaagctcaggaaagtatttctacttcataatcttgaatgtctttataggagttaccattagtgggacattgttcaaaacaatcaaggaagtcaaaccaaaccaaatttgggggttgctggggaaaagcctcccacaaaatgccactttctttctgacgctggttgcattaaagttttttattggctatggactcgaactatcccgtctagttcctcttattattttccatctgaagaggaagtatttctgtaaaactgatgatgaagtgagagaagcttgggctcctggggatattaactatgcaacaagggttcctaatgacttgctcattgttactatagttttatgctattctgtaatagctccaattattattccctttggtgtggcatactttggcgttggctggcttgttcttcggaatcaggcattgaaagtttacgttccatcatatgagagctatggccgtatgtggccccatatgcatgcacgtattcttgcagctctgatcatctaccaagtcaccatgattggctacttcagtattaaaaagttcctctactctccttttgccatccccctccctattttctcaatcgtttttgccttaatgtgtcggaggaaattttacaactcctttctttacactcctctggaagttgtttgtgccaaaacaaaggaaaccccaaatttggaaactatttataactcctacattccaccttgcttgagttcatataagtttgatgaaactcaagagtttggtcatgctttatctgcatttcgagaaacgggatcattggtttgattgcaagtacactgaatttcagcattctatgttaagaagtgtggtgtgtttaaatttttagtcgtgtggtttacaacttatctatagctctgctcttctagttagtacagtctgagagtaattttatgctgttgtgactttctggttcactcg

SEQ ID NO: 461 - protein, 707 aa, Aquilegia spp.
MDLSSFLASLTTSFLVFVILMLVFTWLSRKPGNSVIYYPNRIVKGLKPYEGVRTRSPFAWIKESITSTEDDIISISGVDTAVYFVFLSTVLGILVSSGTLLLPSLLPIAGTAKGDAKNNSNFTSLERISMANVEEKSPRLWAFLLATYVVSFSTLYMLWKAYIHVSELRSTALSAPDVKPEQYAILVRDIPAVPEGQTRKEQVDSYFSLLHGDTFYRSMVVTDNIEVNKIWEDLENYRKKRARAEAILEASKTRPMNKTGFLSGDKVNTIKHCTEMIHELVPKLKIEQENTIREKQQSSALIFFTNRIAATSAAQTIHAKKVDTWTVVEAPEPRQIIWRNLKMKFYQRKLKKDIVFVIVALTIFFYMIPIAFISAFTTMKNLKKLLPFMKPIVDQPQVKTVLEAYLPQIALIVFLALIPKILMFLSKTEGPSISYVVRASSGKYFYFIILNVFIGVTISGTLFKTIKEVKPNQIWGLLGKSLPQNATFFLTLVALKFFIGYGLELSRLVPLIIFHLKRKYFCKTDDEVREAWAPGDINYATRVPNDLLIVTIVLCYSVIAPIIIPFGVAYFGVGWLVLRNQALKVYVPSYESYGRMWPHMHARILAALIIYQVTMIGYFSIKKFLYSPFAIPLPIFSIVFALMCRRKFYNSFLYTPLEVVCAKTKETPNLETIYNSYIPPCLSSYKFDETQEFGHALSAFRETGSLV

SEQ ID NO: 462 - DNA, 2295 bp, Medicago truncatula
atgattctttctgctcttttaacttctgttgcaattaatcttggtctctgtcttctatttttcacactatactctatattgagaaaacagcctggtaatataaatgtatatgtaccacgcttcgttgctgaaggaaaggttaaagaaggtggtcaatttaacttggaacgcctgttacctactgctggttgggtgagaaaggcatgggagccaacagaagacgaatttttatcgacttcaggcttagatgcctttgttttcatgcgcatgtttgtctttagcttgaaagtatttacttttggtgcaattatcggaatcgttcttattccaattaattatatggggagtcagctcactgacgactccgattttcaacacaagtctttggactcgttcagtatttctaatgttaacaacggttcaaacaggttatggatccatttttctgctgcatatgttttcactggagttgtttgctatcttctttattatgagtatcgatacatttcgtccaaacgaatagcttgcttttattcttctgagccacaacctcatcactttaccgtgttggtccgtggtattcctattccacctggaagcacatgtaccgatgctgtccagcgttttttctctgagtatcacccttccacgtatctttcacattcagtcgttcgtcgaagcagcaaacttcacaatcttattactgatgcagataaattgtacaaaaagcttaccaatcttaaacaaaaaaatgatgctcctaaaaggcagacgcgtgaaggttgttgtggactctttgggcctaaagttgatactgtagatcactatgaaaggagacttgggaatatagaagataatgtgagaatggaacagtcctcattggcatcaaaggaagttcctgctgcattcgtttcatttaaaactcgatttggtgctgcaatagctttacacattcaagaaggtgtcaatccaacagaatggattaccgaggaagctcccgaacctcatgatgtttattggcctttctttaccgtttcattccttaaaagatggatcagcaagctggtagtttatgttgcatatactactctcacagttctgtttttaatcccggttgcaatagtacaaggtcttactcatcttgaacagttggaaacgttcttcccgtttttgaaaggcgtactgagactgtcagttgtgagccaagttataacaggataccttccaagtttgattcttcagttgtttctatcatatgttccacctactatgattatgctttcatctttgcaaggatacatttcatggagtcagatacaaaaaagtgcatgcactaaagtgttactgtttaccatatggaacattttctttgcaaatgtactatcagggtctgctctttatcgagtgaacatctttcttgagccgaaaaacatcccaagagtattagccgaagctgtaccctcacaggcatcgttcttcattgcatatgttgtgacatctggatggaccacaatagcatcagagctctttcgattatctacacttatttccaattttttaagtagaactttttgtaaaaacggcgatgatgattttgagcccccgtcaattccttaccacagcgaaattcccaggattcgtctcttcggtcttcttggtgtgacatacttctttcttgctccactcatacttccatttctcttgatttacttttgtttgggatacatcattttccgcaaccagtttttgaaagtttatgtgccaaagtttgagactggaggagagttttggcctacagtgcataactccacgatattttcattgatactaatgcatgtaatagccattgggatttttggtttgaagaaacttcctctagcatcagcattgactcttcctcttccaattctcacacttcttttcaacgagtattgccagaaacggttccgacctatattcaagaattttccagctgagtgtttgattaagaaggacagagcagacgaaatcgagcataatatgtctgaattttatgataaaatggaaaatgcatataatgatccagctctaatgccagtccaatattcagaaaggtttgatagtcaaagatcaccacttcttcatagttctcaattttaattcatattatgaggctggttgctactatgaaaatcagcataccctcagtttgatttcccgatttcctgtaaaatttatttgattgttcgtggcaatgtgttgtaaattgtttggccgagaatttatgctttaatgagtatggaatggaagcttagc

SEQ ID NO: 463 - protein, 712 aa, Medicago truncatula
MILSALLTSVAINLGLCLLFFTLYSILRKQPGNINVYVPRFVAEGKVKEGGQFNLERLLPTAGWVRKAWEPTEDEFLSTSGLDAFVFMRMFVFSLKVFTFGAIIGIVLIPINYMGSQLTDDSDFQHKSLDSFSISNVNNGSNRLWIHFSAAYVFTGVVCYLLYYEYRYISSKRIACFYSSEPQPHHFTVLVRGIPIPPGSTCTDAVQRFFSEYHPSTYLSHSVVRRSSKLHNLITDADKLYKKLTNLKQKNDAPKRQTREGCCGLFGPKVDTVDHYERRLGNIEDNVRMEQSSLASKEVPAAFVSFKTRFGAAIALHIQEGVNPTEWITEEAPEPHDVYWPFFTVSFLKRWISKLVVYVAYTTLTVLFLIPVAIVQGLTHLEQLETFFPFLKGVLRLSVVSQVITGYLPSLILQLFLSYVPPTMIMLSSLQGYISWSQIQKSACTKVLLFTIWNIFFANVLSGSALYRVNIFLEPKNIPRVLAEAVPSQASFFIAYVVTSGWTTIASELFRLSTLISNFLSRTFCKNGDDDFEPPSIPYHSEIPRIRLFGLLGVTYFFLAPLILPFLLIYFCLGYIIFRNQFLKVYVPKFETGGEFWPTVHNSTIFSLILMHVIAIGIFGLKKLPLASALTLPLPILTLLFNEYCQKRFRPIFKNFPAECLIKKDRADEIEHNMSEFYDKMENAYNDPALMPVQYSERFDSQRSPLLHSSQF

SEQ ID NO: 464 - DNA, 2460 bp, Medicago truncatula
atgattttttctgctcttctaacttcaattgcaattaattttggcttttgttctctatttttcaccctgtactctatattgaggaagcaacctggtaatattcttgtctatgcaccacgcttagtttccgaaggaaaactccaagagggcaatcaagataacttggaacatttgttacctacttctggttgggtgagaagagcatgggagccttctgatgatgaatttatatcaactgcaggcttagatgctttcgtcttcatccgtatatttgtctttagtttaaaagtatttgcctttgctggaattgttgggacaatctttcttcttccagttaattacatggggactcagatttgtgatgattccgagtctcagaaaacgtcattggattcctttagtatttcaaacgttaacaatggttcgcacaggttatggattcatttcagcgccgtttatattttcactggggttgtttgcattcttctatattatgagtatgagtacattgcatcaaaaagaattgcttgcttctattcctcgaagccggagcctcgtcagtttagtatattagtacgaggtattccggttcctcctggatgtacatgtagtgaagctgtcgaacaattctttatggagtatcacccttctgcttatcattcacattcagttgttcgtcgaagcagcaaacttcaaattctagttactgatacagatagactgtacaaaaggcttacccaattgaaagataaagaaaactctcctcaaaggcataggcgtgatggatttttaggactttttgggcaaaaagttgatctgttagatcattacgaaaagaaattgggagacattgcagataatgtgagaatagaacagtctgcattggcaggaaaggaagttccagcagcatttgtctcatttaagtcacgattcggtgctgcaatagctttgaactcgcaaccaggtgtcaatcccacacactggatcaccgaaccagcgccagagcctcatgatgtttattggcctttcttttctgtcacattcattcgaagatggatcagcaggctggcagtttttgttgcttgcattgctcttacaattctatttttaatcccagttgcagtagttcaaggccttacccatctcgatcaattagaaaccatgttcccacctctgagaagcatactgagactgacacttgtgagtcaagttataacaggataccttcccattcagattctacagttgtttctgtcttttgtgccagctattatgatttttctttcatccttgcaaggatatatttcatggagtcagatacaaaaaagtgcatgcactaaagtattatggtttaccatctggaacattttctttgcaaacgtattatcagggtcggctctctaccgattgaactactttcttgagcccaaagagtttcctagagtactagctgaagctgtaccagctcaggcatcattcttcatggcgtatattgtggcattcggatggactaatatagcatcagaactttttcaattgattccactttcttacaattatgtaaatagatattttggtggaaactttagtgatgattttgaagcaccatcaattccttactacagcgaaattcccaggattcttttctttggtcttcttggtgttacatactttatccttgctcctctcatactgccatttatcttggtctacttttgtttgggatacatcatttaccgcaaccagctattatatgtttatgtgcaaaaattcgagactggaggagaattttggcctatagtacacaactgcacaattttttcaatggtgctaatgcacatcatagtaattgggatatttgggttgaaggagcttccaatagcatccggattcactcttcctcttcctattgtcacacttcttttcaatgaatactgccagaagcggttcattcctatattcaacgcttatcctgccgaatgtttgatcaagaaagatagagcagatcaaaatgatccgaacatgtccgagttttatgataagttaaccaatgcatacaatgatccagctctaatgccaatcaagtatcccggacggtttagtagtcacagatctcccctacttggtagctcagaatcaaacactaatgttcttgttgctactgaaggcctgtttgtgcttgatagggatggtaatggggcgggatgggatgggttttaccttccccgttcccatacccaactctcatgtacttacctgttattctacccatattcagcggggataagaaatcgattctcatccccatctccgacgggtttgggtatccccgcctcatccccatccccgaatcggataacttttcttaaataaaaatagaagcatttgtcagccccgagcgtaatgttgtaatacattatccagcaaagagatgatggtgatcaattgatatggtgatgg

SEQ ID NO: 465 - protein, 790 aa, Medicago truncatula
MIFSALLTSIAINFGFCSLFFTLYSILRKQPGNILVYAPRLVSEGKLQEGNQDNLEHLLPTSGWVRRAWEPSDDEFISTAGLDAFVFIRIFVFSLKVFAFAGIVGTIFLLPVNYMGTQICDDSESQKTSLDSFSISNVNNGSHRLWIHFSAVYIFTGVVCILLYYEYEYIASKRIACFYSSKPEPRQFSILVRGIPVPPGCTCSEAVEQFFMEYHPSAYHSHSVVRRSSKLQILVTDTDRLYKRLTQLKDKENSPQRHRRDGFLGLFGQKVDLLDHYEKKLGDIADNVRIEQSALAGKEVPAAFVSFKSRFGAAIALNSQPGVNPTHWITEPAPEPHDVYWPFFSVTFIRRWISRLAVFVACIALTILFLIPVAVVQGLTHLDQLETMFPPLRSILRLTLVSQVITGYLPIQILQLFLSFVPAIMIFLSSLQGYISWSQIQKSACTKVLWFTIWNIFFANVLSGSALYRLNYFLEPKEFPRVLAEAVPAQASFFMAYIVAFGWTNIASELFQLIPLSYNYVNRYFGGNFSDDFEAPSIPYYSEIPRILFFGLLGVTYFILAPLILPFILVYFCLGYIIYRNQLLYVYVQKFETGGEFWPIVHNCTIFSMVLMHIIVIGIFGLKELPIASGFTLPLPIVTLLFNEYCQKRFIPIFNAYPAECLIKKDRADQNDPNMSEFYDKLTNAYNDPALMPIKYPGRFSSHRSPLLGSSESNTNVLVATEGLFVLDRDGNGAGWDGFYLPRSHTQLSCTYLLFYPYSAGIRNRFSSPSPTGLGIPASSPSPNRITFLK

SEQ ID NO: 466 - DNA, 2613 bp, Medicago truncatula
atggcttcacttggcgatataggacttgcagctgcaataaacatccttactgcaattgtattcttactggcatttgccatacttcggattcaacctataaacgatagggtgtattttccaaaatggtatatgaagggtttaaggtccagtccattgcaaggaggggcatttgtgagcaaatttgtcaatatagacttcaggtcatacataaggttcttgaactggatgcctgctgcattgcaaatgccggaacccgaactaattgaacatgcaggcttggattctgctgtatacttgaggatctacttactcgggctgaaaatatttgtcccaatttcactcctagcattttctgttatggtccctgtcaattggaccaatgacaccttgaaacgttcaaatgtggtttataccagcatcgataagctttcaatttcaaatattccacttggatcaaatagattttggactcacttggtaatggcttatgcttttaccttctggacatgttatatcttgaaaagggagtatcagatagttgcagcaatgagattgtcttttcttgcatctgaaagacgccgtcctgaccaattcacggtgcttgttaggaatgtaccgcctgatgctgatgaatcagtcagtgaactagttgaacatttctttttggtcaaccatcctgatcaatatctaactcatcaggttgtttacgatgcaaagaaactctctagtctagttgctaagaagaagaaacaacagaattggcttgactactatgaacttaaatattctagaaatgaatccgtaaggccaactaaaaagactggctttttaggtctttgtggcagtaaagtggatgctattgatttttatactgctgcaattgagagactatcaagagacatagagctggagaaagataaggtgacaaagaatcctaaatctataatgccagcagcctttgtttccttcaaaactcgttggggtgctgcagtttgtgcacaaactcaacaaactagaaatccaacaatatggttgactgaatgggctccagagccccgtgacatatactgggataacatggctataccatatgtttctctctcaataaggagacttgtaattggtgttgctttcttctttcttacattctttttcatgattcccattgcattcgtacagtcacttgctaatatagagggcattgaaaaagccgcaccattcctcaagtccattattgaaatcgacgtcatcaagtcttttatacaaggtttccttcctgggattgctttgaagttattcctcatttttttgccaacaatattgatgattatgtccaagttcgaagggtttataagccagtcttctctggaaagaagatgcgcctcaagatattacatcttccagttcattaatgtgtttctggggagcataattaccgggactgcattccaacaactagataaattcattcatcagtctgcaaatgaaattccaaagacaattggtgtttcgattccaatgaaagcaactttcttcataacatacataatggttgatggatgggcaggatgtgctggtgagattttaaggttgaagcctttgatattttatcacttaaagaatttcttgttggtgaagactgaaaaagaccgtgaagaagcaatggatccagggactattggtttcaatacaggagaacctcaaatacaactttatttcttgcttggccttgtgtattctgtagtcacaccatttctacttccatacatcattgtcttttttggtttggcatatcttgtctaccgtcatcagattataaatgtgtacaaccaagaatatgagagtgctggagcattctggcctgatgtccatggacgtattgtatttgcattagttgtctcacaacttctgttaatgggattattgagtacaaaagaagctgctaactcgactccattactcatcgcactcccagttttgacaatatggtttcatcggttttgcaagggaagctacgaacctgcttttactactcatccattacaggaagcaatggtcaaagacacattggagcgtactaaagagccaaacttcaatttgaaagatttcctccatgatgcatatatccatcccgttttcaatgatgacggagacacagacagtgatgtgatgagtcaagaatggaaggaagagccagtaattgtccaaacaaaacgccagtcgcggaagaacacacctgcgcctagcaaacatagtggtggctcattacaaacctctatgcatggtactactgatgtctgatgatgagcattaacagccttagatttgagttgaagtcaaagactaagttagtgttggagcttaattggttcagcataaatctatagacagattgaaggtcctacaagaagcatagagatggtttggttcacaagttactcttgtaaacattgcacagtgatttccagattttcttttgtatatagatatgcaaagcaagaattttgggatgagacagataagagcaatattcaggtcaaattgtaacgagtttttgctctatggatcttctgtatcaaatatactagtgtcttgttttatttttaaaaattg

SEQ ID NO: 467 - protein, 766 aa, Medicago truncatula
MASLGDIGLAAAINILTAIVFLLAFAILRIQPINDRVYFPKWYMKGLRSSPLQGGAFVSKFVNIDFRSYIRFLNWMPAALQMPEPELIEHAGLDSAVYLRIYLLGLKIFVPISLLAFSVMVPVNWTNDTLKRSNVVYTSIDKLSISNIPLGSNRFWTHLVMAYAFTFWTCYILKREYQIVAAMRLSFLASERRRPDQFTVLVRNVPPDADESVSELVEHFFLVNHPDQYLTHQVVYDAKKLSSLVAKKKKQQNWLDYYELKYSRNESVRPTKKTGFLGLCGSKVDAIDFYTAAIERLSRDIELEKDKVTKNPKSIMPAAFVSFKTRWGAAVCAQTQQTRNPTIWLTEWAPEPRDIYWDNMAIPYVSLSIRRLVIGVAFFFLTFFFMIPIAFVQSLANIEGIEKAAPFLKSIIEIDVIKSFIQGFLPGIALKLFLIFLPTILMIMSKFEGFISQSSLERRCASRYYIFQFINVFLGSIITGTAFQQLDKFIHQSANEIPKTIGVSIPMKATFFITYIMVDGWAGCAGEILRLKPLIFYHLKNFLLVKTEKDREEAMDPGTIGFNTGEPQIQLYFLLGLVYSVVTPFLLPYIIVFFGLAYLVYRHQIINVYNQEYESAGAFWPDVHGRIVFALVVSQLLLMGLLSTKEAANSTPLLIALPVLTIWFHRFCKGSYEPAFTTHPLQEAMVKDTLERTKEPNFNLKDFLHDAYIHPVFNDDGDTDSDVMSQEWKEEPVIVQTKRQSRKNTPAPSKHSGGSLQTSMHGTTDV

SEQ ID NO: 468 - DNA, 1386 bp, Medicago truncatula
atgaccaagaaatgtaagaataagttgtccctattggatttttcacaacaaaagacttcaaaagtagatttgcttgaggaaaagcttcaagtcctttgtcacaagattcaccagttacaatgcaaagacatgctcaaggaaaaggagttacctgtcgcttttgttacattcaagtcgcgttctgctgctgtagtagcagctcagttgcagcagcattcacatccacttctttgggtcactgaacttgctccagaaccaagggatgtttcctggaggaatttgagattatcctacagagtccttccgctttgtagactaggcgttgtcattgcggcatcattgcttacaattttctttgccatacctgttactgcagttcaaggaatagccaaatatgaaaaactgaaaaaatggtttcctccagctatggctgtgcagttgataccaggattaagctctattgtgacaggatatcttccaagtgtcgtgctcaaaggatttatatatgttgtgccatttgcaatgtttgctatggcaaaagtagctggatgtgttgcaagaagtaaggaggaaatcaaagcctgcaacatggttttctattttctagttggaaacgtgttcttcgtgagtgtcttatcgggatctctccttgatacactcggaaaatttattagccgtcctaaaagtattccaaatgaacttgccacggctgtctctgcccaagcagatttctttgtgacatacatcttgacagatggactatctggtttttctttggaaattctccaacctggcttacttatttggaatattttaacgtcttgtactcctggccgtcaaagagagaggaatccttatctttattcattgccttactttagaatcatcccttttgtctctctctcaatactaattggtttagtgtatgcagtagttgccccgttgttgctcccatttctcattgtttacttctgtctaggctatgttgtctatatcaaccagattgaagatatgtatgaaactacatacgaaacatgtggacaatattggccatacattcatcactacattctccttgcaatcattctcatgcagattaccatgatcggtctatttggactcaagttaaagccagctgcttccatatcaaccataccactactgttgttcacattgatgtttaatgagtattgcaagttgcgttttctcccttcctttcaccatcagtctctcaaggatgcggctgaaaatgatgaacttgatgaaaagtgtggtcagttggagttccattataagaatgcaggcaatgcctattatccatcaggtctgcaaccagtgagtttcgcggtatcagagtccagctcaacaccattagtatcttcatga

SEQ ID NO: 469 - protein, 461 aa, Medicago truncatula
MTKKCKNKLSLLDFSQQKTSKVDLLEEKLQVLCHKIHQLQCKDMLKEKELPVAFVTFKSRSAAVVAAQLQQHSHPLLWVTELAPEPRDVSWRNLRLSYRVLPLCRLGVVIAASLLTIFFAIPVTAVQGIAKYEKLKKWFPPAMAVQLIPGLSSIVTGYLPSVVLKGFIYVVPFAMFAMAKVAGCVARSKEEIKACNMVFYFLVGNVFFVSVLSGSLLDTLGKFISRPKSIPNELATAVSAQADFFVTYILTDGLSGFSLEILQPGLLIWNILTSCTPGRQRERNPYLYSLPYFRIIPFVSLSILIGLVYAVVAPLLLPFLIVYFCLGYVVYINQIEDMYETTYETCGQYWPYIHHYILLAIILMQITMIGLFGLKLKPAASISTIPLLLFTLMFNEYCKLRFLPSFHHQSLKDAAENDELDEKCGQLEFHYKNAGNAYYPSGLQPVSFAVSESSSTPLVSS

SEQ ID NO: 470 - DNA, 1016 bp, Populus trichocarpa
tttgctaacagccaatttcatctttgcttaatgttgaatgtacctcctgatccagatgaaactgtcagtgagctcttggagcacttttttctagtgaatcacccagatcattacctcactcatcaggtggtgtgcaatgccaacaaactagccagcttggtcaagaagaagaaaaaaaagcagaactggcttgactactaccaactcaagtactccaggaatcaatcgcagaggcctcagatgaagactggtttccttgggcattttgggggaaaagtggatgcaatcgatcatcacatatcagagattgaggaactgtcaaaagaaatagaagaagagaggacaagggttttaaaggatccaaagtctatcatgccagcagcatttgtttcattcaagactcgatggggtgcagctgtgtgtgcacaaacccaacaatcaagaaatccgactttgtggttaacagagtgggctccggagccacgcgatgtatattggcaaaacttagccattccgtacatgtcactcaaagttaggaggctgataattggagttgcattccttttacttaccttctttttcataatacctattgcatctgtacaagctctagcaagtatcgagggaatagagaaaagagccccttttctgaagtctgttattgaaataaaatttatcaaatctgttatccaaggttttcttcctggcattgtgttgaagctcttccttatcttcctgccaacaatattgatgatcatgtctaaatttgaaggcttcatatctctatcatctttggaaaggagatcagcaacgagaaattatattttcctcattatcaatgtattccttgggagcatactcactggagctgcatttgaacagctaaattcttttattaagcagtctgctaacgagtatgttactctcacaaattgattaaatattcatgtcttcattatttaattgctccattagggcgtatgcataattaagtgtgaaggtgtgttcatggcatg

SEQ ID NO: 471 - protein, 301 aa, Populus trichocarpa
MLNVPPDPDETVSELLEHFFLVNHPDHYLTHQVVCNANKLASLVKKKKKKQNWLDYYQLKYSRNQSQRPQMKTGFLGHFGGKVDAIDHHISEIEELSKEIEEERTRVLKDPKSIMPAAFVSFKTRWGAAVCAQTQQSRNPTLWLTEWAPEPRDVYWQNLAIPYMSLKVRRLIIGVAFLLLTFFFIIPIASVQALASIEGIEKRAPFLKSVIEIKFIKSVIQGFLPGIVLKLFLIFLPTILMIMSKFEGFISLSSLERRSATRNYIFLIINVFLGSILTGAAFEQLNSFIKQSANEYVTLTN

SEQ ID NO: 472 - DNA, 941 bp, Populus trichocarpa
catattcatgatttcttcccttttcctgatatgaagctcataggaattcctaaaacaattggtgtagctgttccaatgaaagcaactttcttcataacctatataatggttgatggatgggctgggattgctggggaagttttaatgttgaaaccactgatattctaccacttgaaaaatttccttttggtgaagactgaaaaagacagggaagaggcaatggatcctggaagtcttggttttcacaccggcgaaccccgtatacaattatattttctgctagggcttgtatatgcaacagtgacaccagttctccttccattcatagttattttcttcgccttcgcctatttagtgttccgtcatcagatcataaatgtttacaaccacgagtatgaaagtggtgcagcattctggcctgatgtccatgggcgtattattactgggctagtaatctcacagctggctctgatgggattactgagtacaaaagaagctgcacagtcaacaccatttctcattgctctccctgtcctcactatatggtttcataggttctgcaatggacgccacaaatctgcatttgtcaaatatccattacaggaagcaatgatgaaagataccctggaacgagcaagggatccaaactttaatctgaaagcttgccttcatagtgcatatgttcatccaattttcaaaggtgacgatgatgatgaagacgacctgagcgtagagatggaaactgagagtgtcttagtgcctacaaaacgccaatcgcaaagaaatacaccagtacctagcaaaatcagcgggggatactcaccatctttgccggaggcagttaaaaatggagagctctgaaatggagatcgttaaatatgacacgtgcatgaatacacctcgctgtacatttgacaccatccattgccaggagacagtaa

SEQ ID NO: 473 - protein, 276 aa, Populus trichocarpa
MKLIGIPKTIGVAVPMKATFFITYIMVDGWAGIAGEVLMLKPLIFYHLKNFLLVKTEKDREEAMDPGSLGFHTGEPRIQLYFLLGLVYATVTPVLLPFIVIFFAFAYLVFRHQIINVYNHEYESGAAFWPDVHGRIITGLVISQLALMGLLSTKEAAQSTPFLIALPVLTIWFHRFCNGRHKSAFVKYPLQEAMMKDTLERARDPNFNLKACLHSAYVHPIFKGDDDDEDDLSVEMETESVLVPTKRQSQRNTPVPSKISGGYSPSLPEAVKNGEL

SEQ ID NO: 474 - DNA, 2438 bp, Populus trichocarpa
ttttcttaggtttctttgttgaaggtataaatggcaacgctcgaagatataggggtttcagcagctataaatctactaagtgcattaattttcctatttctatttgcaattttgaggctgcaacctttcaatgatagggtttactttccgaaatggtatctcaagggcttaagaaacagtccctcgcggtcaagggcattggttagtaggtttgtgaatttagactgtagatcatacattcagttcttaaattggatgcctcaagcactgaaaatgccagagcctgaacttattgatcacgcaggattggattctgcggtttacttgcgcatttacttgatgggacttaagatttttgtccctataactatccttgcttgggttgtcctggtaccagttaattacactaataatgctttagaggcagagaagatggcggccaatgtgactgctagtgacatcgacaaactttcgatttcaaatgttccacttaaatcacaaagattctgggctcatatagtgatggcttatgcctttactttctggacttgctatgtactactgaaggagtacgagaaagttgcatcaatgaggttgcaatttctttcctcagaaagacgtcgtccagatcaattcacagtcctagttaggaatgtacctccagatccagatgaatctgttagtgagcttgtggagcacttttttctggtgaatcatccagatcattatctcactcaacaggtggtgtgcaatgctaacaatctagccagcttggtgaagaagaatgaaggcatgcagaactggcttgactactaccgcttcaagtattctagaaatcgatcacagaggcctcagacgaagactggctttcttggtctctggggggcaaaagtagatgcaattgattattacatatcagagattgagaaactgtcgaaagaaataacagaagaaagggaaaaggttttaaatgatccgaattgtatcatgcctgctgcattcgtttcgttcaagactcgatggggtgcagcagtttgtgcacaaactcaacaatcaagaaatccaactttgtggttaacagagtgggctcccgagccgcgcgatgtatattggccaaacctagccattccatatgtgtcgctctcagttagaaggctgataattggagtttcgttcttttttcttgccttctttttcatgatccctattgcatttgttcaatctctagcaagtattgagggaattgagaaaagccttccctttttgaagcctgttattgaagtagaatttatcaaatcagttgtccaaggatttctacctgggattgcgctaaagctctttcttatcttactgccgacgctattgatgatgatgtctaaatttgaaggcttgacatctctatcatctttggaaaggagatcagcaatgagatattacattttcatcattatcaatgtgttcctcggaagcatactcaccggggctgcattcgaacagctagattcttttatcaagcagtctgccagcgaaattcctaaaacaattggtgtagctattccgatgaaggcaactttcttcataacctatataatggttgatggatgggctggaatagctggagaagttctaatgttgaaaccattgataatttaccacttgaagaatttctttttggtgaagactgaaaaagataggaaagaagcgatggatgcaggcagtcttggcttcaacaccggcgaaccccgtatacagctatactttctgctggggcttgtatacgcaccagtcacacctattctccttccattcatagttatgttcttcggcttcgcttatgtggtgtaccgtcatcagatcataaatgtttacaaccaagagtatgaaagtggcgccgcattctggcctgctgtccatggtcgtgttattactgcattagtaatcgcacagctgcttatgatgggactgttgagcacaaagcaagcatccagcacaacaccatttctcattgctcttcctgtcctcactatatggttccatgtcttctgcaacggccgctataaatctgcgtttgtcaaatatccattacaggaagcaatgatgaaagatagcctggaacgagcaagttctccaaacttcaatttcagatcctacctcgagaaagcatatgtgcatccagttttcaaaggagatggcaacgatgatgattatgaacagtatctgagtgaaaaccaggaagctgatgctgagaatgtgttagtgcctacaagacgccactctcgaagaaattcaccagcagtaagccgagcagcttcacctgctttatccgaggaagttcaaagcgtagagcatcgagtgtgacacttgcatgccgattacatctcatacttgttctacagtgggcaaaggaagaagggctagctgaaaaattctcacaggaa

SEQ ID NO: 475 - protein, 775 aa, Populus trichocarpa
MATLEDIGVSAAINLLSALIFLFLFAILRLQPFNDRVYFPKWYLKGLRNSPSRSRALVSRFVNLDCRSYIQFLNWMPQALKMPEPELIDHAGLDSAVYLRIYLMGLKIFVPITILAWVVLVPVNYTNNALEAEKMAANVTASDIDKLSISNVPLKSQRFWAHIVMAYAFTFWTCYVLLKEYEKVASMRLQFLSSERRRPDQFTVLVRNVPPDPDESVSELVEHFFLVNHPDHYLTQQVVCNANNLASLVKKNEGMQNWLDYYRFKYSRNRSQRPQTKTGFLGLWGAKVDAIDYYISEIEKLSKEITEEREKVLNDPNCIMPAAFVSFKTRWGAAVCAQTQQSRNPTLWLTEWAPEPRDVYWPNLAIPYVSLSVRRLIIGVSFFFLAFFFMIPIAFVQSLASIEGIEKSLPFLKPVIEVEFIKSVVQGFLPGIALKLFLILLPTLLMMMSKFEGLTSLSSLERRSAMRYYIFIIINVFLGSILTGAAFEQLDSFIKQSASEIPKTIGVAIPMKATFFITYIMVDGWAGIAGEVLMLKPLIIYHLKNFFLVKTEKDRKEAMDAGSLGFNTGEPRIQLYFLLGLVYAPVTPILLPFIVMFFGFAYVVYRHQIINVYNQEYESGAAFWPAVHGRVITALVIAQLLMMGLLSTKQASSTTPFLIALPVLTIWFHVFCNGRYKSAFVKYPLQEAMMKDSLERASSPNFNFRSYLEKAYVHPVFKGDGNDDDYEQYLSENQEADAENVLVPTRRHSRRNSPAVSRAASPALSEEVQSVEHRV

SEQ ID NO: 476 - DNA, 2435 bp, Populus trichocarpa
tttgttttggttctttttttgaaggtataaatggcaacgcttgcagatatagcggtttcgggggctataaatttactgagtgcattcattttcttattggcatttgcaattttgaggctacaacccttcaatgatagagtttactttccaaaatggtatctgaagggcttaagaagcagcccctcgcgctctggggcatttgttcgtagggtggtgaatttagactttaggtcatatatccggtttttaaattggatgccggaagcgcttaaaatgccggagcctgagcttattgatcatgcagggttggattatgctgtttacttgcgcatttacttgatgggacttaaaatttttgtgcctataacattccttgcttgggctatcctggtgccagtcaattacactaatgatgctctagaggcagccaagatggtggccaatgtgactgctagtgacattgacaagctttcaatttcgaatataccacttaaatcacaaagattttggacgcatatagtgatggcttatgcctttactttctggacgtgctacgtgttgctaagggagtatgagaaagttgctgcgatgaggttgcaatttctttcctcagaaagacgtcgtccagatcaattcacagtccttgttaggaatgtacctccagatccagatgaaactgtcagtgagcttgtggagcacttttttctagtgaatcatccagatcattacctcactcatcgggtggtgtgcaatgccaacaaactagccagcttggtgaagaagaagaaaaaaaagcagaactggcttgactactaccaactcaagtactccaggaatcaatcgcagaggcctcagatgaagactggtttccttgggcattttgggggaaaagtggatgcaatcgatcatcacatttcagagattgaggaactgtcaaaagaaatagaagaagagaggacaagggttttaaaggatccaaagtctatcatgccagcagcatttgtttcattcaagactcgatggggtgcagctgtgtgtgcacaaactcaacaatcaagaaatccaactttgtggttaacagagtgggctccggagcctcgcgatgtatattggcaaaacttagccattccatacatgtcactcaaagttaagaggctgataattggagttgctttctttttccttaccttctttttcatgatacctattgcatctgtacaagcgctagcaagtattgagggaatagagaaaagagccccttttctgaagtctgttattgaaataaaatttatcaaatctgtcatccaaggttttcttcctggcattgcattgaagctcttccttatcttcctgccaacaatattgatgatcatgtctaagtttgaaggcttcgtatctctatcttctttggaaaggagatcagcaacgagatactatattttcctcattatcaacgtattcctagggagcatactcactggagccgcatttgatcagctaaatgcttttattaatcagtctgctaacgaaattcctaaaacaattggtgtagctgttccaatgaaagcaactttcttcataacctatataatggttgatggatgggctgggattgctggggaagttttaatgttgaaaccactgatattctaccacttgaaaaatttccttttggtgaagactgaaaaagacagggaagaggcaatggatcctggaagtcttggttttcacaccggcgaaccccgtatacaattatattttctgctagggcttgtatatgcaacagtgacaccagttctccttccattcatagttattttcttcgccttcgcctatttagtgttccgtcatcagatcataaatgtttacaaccacgagtatgaaagtggtgcagcattctggcctgatgtccatgggcgtgttattactgcactagtaatctcgcagctggctctgatgggactgatgagtacaaaagaagctgcacagtcaacaccatttctcattgctctccctgtcctcactatatggtttcataggttctgcaatggacgccacaaatctgcatttgtcaaatatccattacaggaagcaatgatgaaagataccctggaacgagcaagggatccaaactttaatctgaaagcctaccttcagagtgcttatgttcatccagttttcaaaggtggtgatgatgatattgatgaagacgaccttctgagcggaaagatggaaaccgagagtgtcttagtgcctacaaagcgccaatcacgaagaaatacaccagcaccaagcaaaatcagcgggggatcctcaccatctttgcccgagacagttaaaaatggagagccttgaaacagagatcgttacacgtgcatgactacacctcgcagtacattagacacaatccattgccaggagacagtgatccgttg

SEQ ID NO: 477 - protein, 774 aa, Populus trichocarpa
MATLADIAVSGAINLLSAFIFLLAFAILRLQPFNDRVYFPKWYLKGLRSSPSRSGAFVRRVVNLDFRSYIRFLNWMPEALKMPEPELIDHAGLDYAVYLRIYLMGLKIFVPITFLAWAILVPVNYTNDALEAAKMVANVTASDIDKLSISNIPLKSQRFWTHIVMAYAFTFWTCYVLLREYEKVAAMRLQFLSSERRRPDQFTVLVRNVPPDPDETVSELVEHFFLVNHPDHYLTHRVVCNANKLASLVKKKKKKQNWLDYYQLKYSRNQSQRPQMKTGFLGHFGGKVDAIDHHISEIEELSKEIEEERTRVLKDPKSIMPAAFVSFKTRWGAAVCAQTQQSRNPTLWLTEWAPEPRDVYWQNLAIPYMSLKVKRLIIGVAFFFLTFFFMIPIASVQALASIEGIEKRAPFLKSVIEIKFIKSVIQGFLPGIALKLFLIFLPTILMIMSKFEGFVSLSSLERRSATRYYIFLIINVFLGSILTGAAFDQLNAFINQSANEIPKTIGVAVPMKATFFITYIMVDGWAGIAGEVLMLKPLIFYHLKNFLLVKTEKDREEAMDPGSLGFHTGEPRIQLYFLLGLVYATVTPVLLPFIVIFFAFAYLVFRHQIINVYNHEYESGAAFWPDVHGRVITALVISQLALMGLMSTKEAAQSTPFLIALPVLTIWFHRFCNGRHKSAFVKYPLQEAMMKDTLERARDPNFNLKAYLQSAYVHPVFKGGDDDIDEDDLLSGKMETESVLVPTKRQSRRNTPAPSKISGGSSPSLPETVKNGEP

SEQ ID NO: 478 - DNA, 2606 bp, Populus trichocarpa
ctatctctctctgtccttctattgtctaccatggcaactcttcaggacataggagtctcagctctcattaacattcttggtgcttttgcattcttgctagcttttgctctcctcagaatccaacccatcaatgacagagtttactttccgaagtggtacattagtggaggaaggagcaacccaagaagggctggtaactttgtgggcaaatttgtcaacctcaatgtcaagacttactttactttcttgaattggatgcctcaagccttgaagatgaccgaagcagagattatcaatcatgctggtcttgactctgctgtttttttgaggatttacactctcggcttaaagatttttgtgccaattacaatccttgcgctcttaattctcattccagtgaatgtatctagcggaacactattcttcttaaggaaagaattggttatgagtgacattgacaagctttcgatatcaaatgttcgtcctcaatccataaggcaagtttttgcatttgcatatgaagaaaagggaaaatccatgattatgttttttatccacatagcattggaatatgcattcactatatggatttgcttcatgctctacaaagaatacgatcatgtagcattgatgagattgcgcttcttggcttcaaaaagaagacatgctgaacagttcactgtagtggtgaggaatgtcccacatgtttctggccggtcagtattagacacagtggaacaattttttcaaacaaaccatccaaatacttatctttgtcagcaggccgtctataatgcaaacaaatttgcaaagcttgtgagaaaaagagatagacttcaaaattggctcgattacaaccagcttaaatttgaaagacatccagacaagaggcccactcgaaagaatggttttctaggactttggggtgaaagagttgattctattgaacactacaaacaacaaatgaagcatttggagaaaaacatggcatcggaacgccaaacaattctcaaagactcaaaatctatattgccagtttcttttgtttcttttaattcgcgttggggggctgctgtttgtgcacaaacacaacagagcaagaatccgactttatggttgacaaattgggccccagaaccccgtgatatttattggcgtaatctggctataccgttcatgtcattgacagtccgaaagcttataatatctgtgacagtttttgccttggtgtttttctacatgatacccatagcttttgtgcaatcccttgcaaacttagagggtctcgagaaagtagctcctttcctcaggccagtcatagaattgaaattcatcaagtcattcctacaaggtttccttcctggtctagcacttaaaatctttttgtacattctaccaacagttttgatgataatgtcgaaaatcgagggatatattgcacattcaactctggagcgaagagcagcagcaaagtattattactttatgttagtgaacgtattcttgggaagcataattgctggaacggcttttgagcagctggatgcttttcttcaccaatcaccaacccagattcctaggactattggggtttccataccaatgaaggctacctttttcattacatatattatggttgatggatgggctggtattgctggagagattctcagattgaagccattgatcatatttcatcttaagaatatgtttttggtaaagactgaaagagacatagaaagggccatggaccctggtagtgtagatttcccagagactctcccaagcctccaactatactttcttttgggaatcgtgtatgcagtggttactccaatactgcttccttttgttctagtattctttgcttttgcatacttggtttaccgtcatcagatagttaatgtctacaatcaacaatacgagagtgctgctgcattttggccacatgttcacagccgtataattgcaagcttattgatatctcaactcttacttttgggcttgctcagcacaaaaaaggcagctaattccactcctttgttagttatcttgcccgtattgacgttatccttccacaagtattgcaagattcgctttgagcctgcatttaggaagtaccctcttgaggaagccatggcgaaagatataacagaccgtactgcagaatctgatatgaacttgaaagcatatttggctgatgcatatttgcacccaattttccgttcatttgaagaaccattggtcgaggtcaaggtagaaaaaaacaaaccacaaactgctagtgatcgaatcagtgaactcagctccccttctcctccacatcaagtcaatcatccttcttccccaccacatcaagtcaatcatccttcttccccgccacattatgtctatcatccttcttctccacctcagcatgtctatgacccttcctctccatcccattatgcgtatcattacgaaaatgatatctttcatgcccccaccccaccccattatgcctatcattacgaaaatgagccttgatattatggagctactaatctacaagatcgattgctaaccattttttgtttttgtttttaaattcccaatttcggctgctc

SEQ ID NO: 479 - protein, 831 aa, Populus trichocarpa
MATLQDIGVSALINILGAFAFLLAFALLRIQPINDRVYFPKWYISGGRSNPRRAGNFVGKFVNLNVKTYFTFLNWMPQALKMTEAEIINHAGLDSAVFLRIYTLGLKIFVPITILALLILIPVNVSSGTLFFLRKELVMSDIDKLSISNVRPQSIRQVFAFAYEEKGKSMIMFFIHIALEYAFTIWICFMLYKEYDHVALMRLRFLASKRRHAEQFTVVVRNVPHVSGRSVLDTVEQFFQTNHPNTYLCQQAVYNANKFAKLVRKRDRLQNWLDYNQLKFERHPDKRPTRKNGFLGLWGERVDSIEHYKQQMKHLEKNMASERQTILKDSKSILPVSFVSFNSRWGAAVCAQTQQSKNPTLWLTNWAPEPRDIYWRNLAIPFMSLTVRKLIISVTVFALVFFYMIPIAFVQSLANLEGLEKVAPFLRPVIELKFIKSFLQGFLPGLALKIFLYILPTVLMIMSKIEGYIAHSTLERRAAAKYYYFMLVNVFLGSIIAGTAFEQLDAFLHQSPTQIPRTIGVSIPMKATFFITYIMVDGWAGIAGEILRLKPLIIFHLKNMFLVKTERDIERAMDPGSVDFPETLPSLQLYFLLGIVYAVVTPILLPFVLVFFAFAYLVYRHQIVNVYNQQYESAAAFWPHVHSRIIASLLISQLLLLGLLSTKKAANSTPLLVILPVLTLSFHKYCKIRFEPAFRKYPLEEAMAKDITDRTAESDMNLKAYLADAYLHPIFRSFEEPLVEVKVEKNKPQTASDRISELSSPSPPHQVNHPSSPPHQVNHPSSPPHYVYHPSSPPQHVYDPSSPSHYAYHYENDIFHAPTPPHYAYHYENEP

SEQ ID NO: 480 - DNA, 2285 bp, Populus trichocarpa
atttcacagtaattctgttctgagcgagtgatggatttctcatctttcttgacgtctttagggacgtcgtttttgattttcgtagtgttaatgcttctgtttacatggctgtcgaggaagcctggaaactccttcgtgtattaccccaaccggatcttgaaaggtctggaaccctgggatggcgcgtcaagatcccgcaacccgtttgcttggatccgggaagccttctcttccagcgagcaggacgttataaacatgtccggtgtagacactgctgtctactttgtcttcttgagcactgctctggcaatattggttttgtctggccttgttctgctgccggtacttctgcctgttgctgccaccgacgacaatgtgaaaacacaaaaagataaaggcaatcagagttttagtgacattgacaagttattaatgggaaatgttaagggggggagtccaaggctgtgggcattcttgattgctacctattgggtttctcttgttacctatttcttgctatggaaggcgtacgtgcatgtttctgggctgagagcaaatgctctaatgtctcctgaactgacaccagagcaattcgctgttcttgtcagagacatacctcctgtccctgagggccgaactagaaaggaacaggttgattcatattttaaatccatctatcctgagacattttatagatcaatggtggtgacaaacaacaaagaggttaacaagatttatatagagttggaaggatacaagaagaagcttgcacatgcagaagctgtatacgatgaatccaaaaaaacaggcaaaccagaaggattgagaccaaccatcagaactggcccccttggtattgttggtagaaaggtagatagcatagagcactacaatgagaagattaaagagctaatcccaaagttggaagctgaacagaaagtcactctccgggagaatcaacaagcttgtgcttttgccttcttcaccaatagggtgactgcagcttctgccgcccagagtctacatgcccaaatggttgacacctggactgtcatggaagcccctgaaccacgtcaaataatatggtctaatcttaaaattaagtattttcaaaggataatccggcagtatgttgtttgttttattgtggctctgaccatattgttttatatgataccaatcgggctcatttccgcattaacaaccctggataatctgaagaaaattctcccatttttaaagccaattgtgaatattgtcgcagttaagacggtgctggaagcgtaccttcctcagattgcactcattgtgtttttggcactgttgcccaagttacttttggctctctccaaggctgagggaattccttcagtgggccatgcagtaagggccacttctggaaaatatttctattttaccatactgaacgtttttattggagtgacactgggtggcaccttattcaccacgttcaagagcattgaggagaaaccaaactccattgttagtttgcttgcgagtagcctcccggggaatgcaactttcttcctgacttttgtggctctgaagtttttcgttggctatggactcgagctgtctcgtatagttcctctaatcatttttcatctaaagaagaagtatctttgcaagaccgaagcggagttaaaagaagcttggtttcctggagatttagggtatgcaacccggattcctggtgacatgcttgttctcacaattgttctttgctactctgtcatagcccctctgattattccatttggagtggtgtactttggcctgggatggcttgtccttaggaatcaggcactcaaagtatatgctccatcctttgagacctatggcaggatgtggccccacatccacacaagagtcattgctgctctgatattattccaagttacaatgttcggttattttgtggtgaagaaattctccttcagtactttcttactaattccactgccgatactttccttgctgttcgcctatgtctgtcacaagaaattctatcgatctttctctgacacagcccttgaagttgcttgccgtgaattgaaggaaattcctaacatggaacgcatctacagatcttttatcccaccaagcttgagctctgaaaaggccgatgatgaccacttcgaagatgcattatcacaagtttcaagagtcggatcgtttgcatgatattactgtgttggtagctagctaattgctcgatgaagtcttgtagtacctttagcttctaaaacttggaccatttgtcg

SEQ ID NO: 481 - protein, 724 aa, Populus trichocarpa
MDFSSFLTSLGTSFLIFVVLMLLFTWLSRKPGNSFVYYPNRILKGLEPWDGASRSRNPFAWIREAFSSSEQDVINMSGVDTAVYFVFLSTALAILVLSGLVLLPVLLPVAATDDNVKTQKDKGNQSFSDIDKLLMGNVKGGSPRLWAFLIATYWVSLVTYFLLWKAYVHVSGLRANALMSPELTPEQFAVLVRDIPPVPEGRTRKEQVDSYFKSIYPETFYRSMVVTNNKEVNKIYIELEGYKKKLAHAEAVYDESKKTGKPEGLRPTIRTGPLGIVGRKVDSIEHYNEKIKELIPKLEAEQKVTLRENQQACAFAFFTNRVTAASAAQSLHAQMVDTWTVMEAPEPRQIIWSNLKIKYFQRIIRQYVVCFIVALTILFYMIPIGLISALTTLDNLKKILPFLKPIVNIVAVKTVLEAYLPQIALIVFLALLPKLLLALSKAEGIPSVGHAVRATSGKYFYFTILNVFIGVTLGGTLFTTFKSIEEKPNSIVSLLASSLPGNATFFLTFVALKFFVGYGLELSRIVPLIIFHLKKKYLCKTEAELKEAWFPGDLGYATRIPGDMLVLTIVLCYSVIAPLIIPFGVVYFGLGWLVLRNQALKVYAPSFETYGRMWPHIHTRVIAALILFQVTMFGYFVVKKFSFSTFLLIPLPILSLLFAYVCHKKFYRSFSDTALEVACRELKEIPNMERIYRSFIPPSLSSEKADDDHFEDALSQVSRVGSFA

SEQ ID NO: 482 - DNA, 2231 bp, Populus trichocarpa
attttggcagataaaaacagtggagattagatggacattggtgcccttttaacttcggccgctatcaatacaggtttatctgtgttgcttttttcactgtattcaatattgagaaaacaaccaagcaacacgattgtgtatttcgggcggaggcttgcttctttaaacaacagaaatagcagaaatcatttctccttcgaaaggtttgtgccctctcccagttggatcgtcaaggcatgggaaacaacagaaaatgaaatcttggccattggtggccttgatgctgtggttttccagaggatacttgttttcagttgtatacagtatcagagtcttttctattgcagctgttacgtgtctgttcctggtgcttccagtgaattattatgggcaggagatgaaacacaagcatatccatgccgagtccctcaatgtatttacaattgcaaatgtgaaagaaggctccagatggctttgggcacactgtctcgcattatatatcatatcctgctcagcttgtgttcttctttactttttgtgtgtaccaatgtgttaagattattaacaacacccccttctctccaggaatacaaaagcatcaccaagatgaggctagcacacataacaacatctcctccaaatccaagtcattttaccattcttgtccgttcaattccatattcagtgggagaatcatacagtaattctgtgaagaaattctttacaaattattatgcatcgagctacttgtctcatcaaattgtgtatcgatgtggtttagttcaaaaattgatggttgatgcagaaaagatatgcatgaggattaaggctgctcccaagggccaatcaagtttaaagccatgttgtctgtgtggaggaagtacttcgtttaaggtcctcactgatgaaccagaaagtgtcaaggacagtttcagttattctaatttgaatcttgccaccagagataatgagcgttctgctgcttttgttattttcaagacccgctatgctgctgtggttgccacacagatgcttcaatcaccaaatcccatgtcatgggtgacagaattggccccagaaccacatgatgttttatggtcaaatctctgtataccatttagacagctttggctccggaagatagcaactcttctggcatctatagtcttcatggttctgtttcttgctccagtgacctttgtacaaggcttgactcaactagagaagctgtcacaaacatttccttttctgagagggtttctaaaacatgtaggagacattcctgtagaacttgccaaagcaataccaaatcaggctagcttctttgtgacttatgttttaacatcaggttgggcaagtctgtcatgtgaagtgatgcaacctttttctctcctctgcaatttccttaaaaaacaccttcttagaaaccatgaagactcatctgatggtcttgtgtcctttccataccatactgaagttccaagagtcttgctgtttggtctcattggcttcacctattcggttatggcacctttaatattgcccttcttgctgatttactttttactggcatatctggtatatcgaaatcagattgtcaatgtatacataacaaagtatgaaggcggtggacagttgtggcctattgttcacaacaccacaatcttttcattggtgctgacacaaatgatatctcttggtgtttttggaattaaaaaatctccagtcgcatcgggtttcaccattccattgataatttgcacacttctatttaatgagtattgcaggcagcgatttttcccaatttttaagaagaatgttgcacaggtgatcatgaggaactggtttgcttttgaatctctctcttcctgtctgtccaaagttaataaattattttgtcctgttcaggttcttttagagatggatagacgagatgagcagtctgggcggatggaagagatccatcaacagttgcattcagcctactgtcagttaccgctaacttcccatgaattctgtgaatctgtacacaagctctgtcaggacaacatccgaggccgagagggcaccaagtcaggaaaagaaccaagtgaagtaagtgaaccctgtgctgtctgcaattttggaaaagaaggttctattggggagtgatctagcttatcccctgtacatataaacgccatctacacactgatggtactttccagtgcaaaggtattttgaagagaagt

SEQ ID NO: 483 - protein, 706 aa, Populus trichocarpa
MDIGALLTSAAINTGLSVLLFSLYSILRKQPSNTIVYFGRRLASLNNRNSRNHFSFERFVPSPSWIVKAWETTENEILAIGGLDAVVFQRILVFSCIQYQSLFYCSCYVSVPGASSELLWAGDETQAYPCRVPQCIYNCKCERRLQMALGTLSRIIYHILLSLCSSLLFVCTNVLRLLTTPPSLQEYKSITKMRLAHITTSPPNPSHFTILVRSIPYSVGESYSNSVKKFFTNYYASSYLSHQIVYRCGLVQKLMVDAEKICMRIKAAPKGQSSLKPCCLCGGSTSFKVLTDEPESVKDSFSYSNLNLATRDNERSAAFVIFKTRYAAVVATQMLQSPNPMSWVTELAPEPHDVLWSNLCIPFRQLWLRKIATLLASIVFMVLFLAPVTFVQGLTQLEKLSQTFPFLRGFLKHVGDIPVELAKAIPNQASFFVTYVLTSGWASLSCEVMQPFSLLCNFLKKHLLRNHEDSSDGLVSFPYHTEVPRVLLFGLIGFTYSVMAPLILPFLLIYFLLAYLVYRNQIVNVYITKYEGGGQLWPIVHNTTIFSLVLTQMISLGVFGIKKSPVASGFTIPLIICTLLFNEYCRQRFFPIFKKNVAQVIMRNWFAFESLSSCLSKVNKLFCPVQVLLEMDRRDEQSGRMEEIHQQLHSAYCQLPLTSHEFCESVHKLCQDNIRGREGTKSGKEPSEVSEPCAVCNFGKEGSIGE

SEQ ID NO: 484 - DNA, 2414 bp, Populus trichocarpa
aaagtggatagatagatagacagaaaacatatggcgacactgagtgatataggagtagcagcagctattaacattctcactgcgtttgctttcttcttcgcatttgcaattctccggattcaaccagtcaatgatagggtctactttcccaaatggtatatcaaggggttaaggagcagtcctttcggcactggtgcctttgttggcaaggttgtcaatttggacttcaggtcatatgtgaggtttctcaactggatgcctgcggcattacatatgccggaacctgagctcattgaccatgctggattggactctgctgtttacttgaggatttacctgatagggcttaagatttttgttcctattgcattcctggccttcactatcctggtgccagtgaactggacaaatagcactttggagcgttctaatttgacttacagtgatttagataagctctctatttcaaatatacccacaggatcaaacagattctggacccatttggtgatggcctatgcctctaccttttggacatgctatgtgctaaaaaaagagtatgagatagtggctaaaatgaggttgcattttcttgcatcagaaaaacgacgtcctgatcaatttacagtactggttagaaatgtgccaccagatgctgatgaatcggttagtgaactcgtggagcactttttcctagtcaaccatcctaatgattatctcacttaccaggttgtctacaatgctaatcaactttctcacctagtcaacgagaagaaaaagatgaagaactggcttgactattatcaaatcaaatattcaagaaacaaatccagaatgccctccctcaagactggttttcttggccttttcgggactagggtggatgcaattgatcattatacatctgagattgagagactgtctagaaaaatctccttggagagagatgagattgtgaacaatgccaaggcaatcatgccagcagcatttgtttccttcaaaactcgatggggagctgctgtttgtgcacaaacacaacaatccagaaatccagctatgtggttgactgagtgggctcctgaaccccgtgatgtatactgggacaacctcgcaattccatttgtttcactggcactaagaaggctcgttatcgctgtcacatttttcttccttactttcttctttatggttcccattgcatttgtacagtcccttgcaaacattgaaggaattgagaaagcactcccgttcctgaaacctataattgaaatgaaagtgataaagtcattcattcaaggtttccttcctggaattgctttgaagatatttcttatttttctaccctccatattgatgctaatgtctaaatttgagggattcattagcatatcaggcctagagaggagatctgcggctagatattatatcttccagttcattaatgtatttctcggaagcataatcaccggaactgcatttcaacaactggataattttatccaccagtctgcaactgaaataccaaagacaatcggagtatccatacctatgaaagcaactttcttcataacttacatcatggttgatgggtgggctggagttgctggggagattttaagattgaaacccttgataatctatcacctgaaaatgtttttcatggtgaagaccgaaaaggacatggaagaggcgatggatccaggaactcttggtttcaacacaggggaaccacaaatacaactttatttcttacttggcctcgtttatgctgtggtgtcgcccatcttacttcctttcattatagtattctttgccctcgcatttgttgtgtatcgtcatcagattataaatgtttacaatcaggagtatgagagtgctgcagcattctggcctgatgtccatggacgcatcatagtagcagtaattgtctcacagctgctgctaatgggattgttaagcacaaaagaagcggctcagtcaacaccgttgctcattacactcccagtattgacaatatggttccatttgttctgcaaaggccgttatgaacctgcttttgttagatatccattgcaggaagcaatgatgaaagatacattggaacgcgccaaagagcccaacctgaacttgaaaagcttccttcaaaacgcttacatccacccagtttttaaaggcgaagacgatagtgacagcgatgaagcgcctgaagagtttgagaaagaacctgatctggtcccaacaaagcgccagtctcgaaggaatacaccattgccaagtaagcatggctcggctgcatcctcccagcctgaagctcaggattatccactactttgaaactcgtgtgtaaatgcgagtccttggaaaattaagctggctgagctcagaagagattgtacatgggatagtaggctaag

SEQ ID NO: 485 - protein, 767 aa, Populus trichocarpa
MATLSDIGVAAAINILTAFAFFFAFAILRIQPVNDRVYFPKWYIKGLRSSPFGTGAFVGKVVNLDFRSYVRFLNWMPAALHMPEPELIDHAGLDSAVYLRIYLIGLKIFVPIAFLAFTILVPVNWTNSTLERSNLTYSDLDKLSISNIPTGSNRFWTHLVMAYASTFWTCYVLKKEYEIVAKMRLHFLASEKRRPDQFTVLVRNVPPDADESVSELVEHFFLVNHPNDYLTYQVVYNANQLSHLVNEKKKMKNWLDYYQIKYSRNKSRMPSLKTGFLGLFGTRVDAIDHYTSEIERLSRKISLERDEIVNNAKAIMPAAFVSFKTRWGAAVCAQTQQSRNPAMWLTEWAPEPRDVYWDNLAIPFVSLALRRLVIAVTFFFLTFFFMVPIAFVQSLANIEGIEKALPFLKPIIEMKVIKSFIQGFLPGIALKIFLIFLPSILMLMSKFEGFISISGLERRSAARYYIFQFINVFLGSIITGTAFQQLDNFIHQSATEIPKTIGVSIPMKATFFITYIMVDGWAGVAGEILRLKPLIIYHLKMFFMVKTEKDMEEAMDPGTLGFNTGEPQIQLYFLLGLVYAVVSPILLPFIIVFFALAFVVYRHQIINVYNQEYESAAAFWPDVHGRIIVAVIVSQLLLMGLLSTKEAAQSTPLLITLPVLTIWFHLFCKGRYEPAFVRYPLQEAMMKDTLERAKEPNLNLKSFLQNAYIHPVFKGEDDSDSDEAPEEFEKEPDLVPTKRQSRRNTPLPSKHGSAASSQPEAQDYPLL

SEQ ID NO: 486 - DNA, 2291 bp, Populus trichocarpa
tggtagtgagtctgaatctgagtgatcaaaatgaatccagaaagtcttactgcatcggcagccattaactttggcttggcattcatagttctctcactcttctccattttcaagaaacaaccttctaatgcctccatttactacgctcgtcgcctctccaaacgacaccatgatcactttgagcagtctttcactctttcccgctttcttccttcagttgcttggattcctcgtgcttttcgagtcactgaagatgaagttcttgatattggtggccttgatgctctcatcattatcagactcttcaaatttgggatatatttctttggaatttgttctcttattggattagtggtacttctgccaatcaatttcggtgaccaagatgaacaatctagcatctaccattccatggatcctttcacaatatcaaatattagtgcaggttcgaacaggttgggtttcccatcttgcttatggttgttcaggctttgggtgcattttacgtgcttgtggttgatatcattttatggattatatctgttgtacaaggaatatgacggaatttcggttaaacggatccaactacttcggaacctaaggcatcaacctgatcggtttaatgttcttgttcggcaagttcccttctgcaatgaacacaacgcttatgggtgctctgttgatcacttcttctctaaacatcatcctaacagttactgttcttatcagatgatatatgatggaaaagatatcgaagatctgctgcaccaagcaaaatatgttgcgagaaagatagaggacatgagaggaaagctcacagttaagaaacgcgacaaggaaagcttactcttagatgtatctcaagaagatgatgtgaaaatagctttgtttgaggaaaagcagcaagaaaatgttcgtaagattcgtcaattacagaacgaaagtatgctgaaaggaaaggagttgcctgttgcctttgttacattcaagtcccgacgtggtgcagcattagtttcccaaactcaacagcactcacatccactcatatggatcacggaaatggctccagaaccaagggatgtatcatggaggagtctggaaattccctttaagattttgccactttgcaaaatcggggtcgttgttgcagcatctctcctcacaattttctttgcagtcccagttacagctgttcaaggaatagctaaacttgagaaacttaagaaatggttccccccagccatggctatggagctaataccaggattaagctccattattacagggtatcttccaagtgccattctcaaaggctttatatatgttgttccctttgcaatgcttggcatggctaaattaggcggttcgatttcaaagagcaaggaggagattaaagcttgcaatatggttttctactttctcgtgggaaatgtattctttttgagtttgatatcaggatccctacttgatgagcttggagaatattttacccaccctaggagtattcctagtcatcttgccagtgctgtctcttctcaagctgattttttcgtgacatacatcttaacagatgggttgtcaggattttctttggaaatccttcagcccggcttgcttgtttgggatgccgtgaaatcacacacagttggcggatcaggagacgaggaaaatccttacctttattcattgccctattttagaatcatcccttcagtctccctatcaatactcattggtatggtatatgcagttgtcgctccattgctgcttccatttcttgttggctacttctatctaggctacgttgtatatgtcaaccagattgaagatgtttacgaaactgcttatgatacatgcggacagtattggccatacgttcatcattatatattcgtcggaatcattcttatgcaaatcaccatgattggtctttttgggctgaagtcaaaaccttctgcttccatagccacaattccactcttattgcttactataatgttcaatgagtactgcaagatacgttttctacctacttttcgccactattctgttaaggatgcggatgaacatgatgaactagataggaagttcggtaagatggaaataaattgtgagaatgccagaagtgcctattgtcagcccactttacaaccagcaaacttcatggcatcaaagtctacttcctcgcagccattggtttcttcattgtgatatcttaacattgtaattcattttcttcctttctcttgtactttcgagtacattcacctgagttttccgaaaaattatta

SEQ ID NO: 487 - protein, 726 aa, Populus trichocarpa
MNPESLTASAAINFGLAFIVLSLFSIFKKQPSNASIYYARRLSKRHHDHFEQSFTLSRFLPSVAWIPRAFRVTEDEVLDIGGLDALIIIRLFKFGIYFFGICSLIGLVVLLPINFGDQDEQSSIYHSMDPFTISNISAGSNRLGFPSCLWLFRLWVHFTCLWLISFYGLYLLYKEYDGISVKRIQLLRNLRHQPDRFNVLVRQVPFCNEHNAYGCSVDHFFSKHHPNSYCSYQMIYDGKDIEDLLHQAKYVARKIEDMRGKLTVKKRDKESLLLDVSQEDDVKIALFEEKQQENVRKIRQLQNESMLKGKELPVAFVTFKSRRGAALVSQTQQHSHPLIWITEMAPEPRDVSWRSLEIPFKILPLCKIGVVVAASLLTIFFAVPVTAVQGIAKLEKLKKWFPPAMAMELIPGLSSIITGYLPSAILKGFIYVVPFAMLGMAKLGGSISKSKEEIKACNMVFYFLVGNVFFLSLISGSLLDELGEYFTHPRSIPSHLASAVSSQADFFVTYILTDGLSGFSLEILQPGLLVWDAVKSHTVGGSGDEENPYLYSLPYFRIIPSVSLSILIGMVYAVVAPLLLPFLVGYFYLGYVVYVNQIEDVYETAYDTCGQYWPYVHHYIFVGIILMQITMIGLFGLKSKPSASIATIPLLLLTIMFNEYCKIRFLPTFRHYSVKDADEHDELDRKFGKMEINCENARSAYCQPTLQPANFMASKSTSSQPLVSSL

SEQ ID NO: 488 - DNA, 1661 bp, Populus trichocarpa
ccactcaaaattgttgataaaaattgcttaatgcatgtatttgatgcccatatgtttcagatggcatcggagcgccaaaaaattcttgaagactcaaaatctatcttgccagtttcttttgtttcttttaattcacgctggggggcagctgtttgtgcacaaacacaacaaagcaagaacccaacattatggctgacaaattgggctccagaacctcgcgatatctattggcgtaatttggctataccattcgtgtcactgactgttcgaaagcttataatatctttgtcagtgtttgctttggtgtttttctacatgatacctatagcttttgtgcaatcccttgcaaatttagagggtcttgagaaagttgctcctttccttaggccggtcatagaactgaaattcatcaagtcattcctacagggtttccttcctggtcttgcacttaaaatctttttgtatatactaccagcggttttgatgataatgtcaaaaatcgagggatatattgcacattcaactttggagcgaagagcagcagcaaagtattattactttatgttagtgaatgtattcttggggagcataatagctggaacggcattcgagcagctggatgctttccttcaccaatcaccaacccagattcctagaactattggggtttccataccaatgaaggctacctttttcattacatatataatggttgatggatgggctggtattgctggagagattctcagattgaagccattgatcatatttcatcttaagaacatgtttttggtaaagactgaaagagacagagaaaaggccatgaatcctggtagtgtagatttcccagagactctcccaagcctccaactatactttcttttgggaatcgtatatgctgtggttactccaatactgcttccctttattctagtattctttgctttcgcatacttggtttaccgtcatcagataatcaatgtctacaatcaacaatacgagagtgctgctgcattttggccacatgttcacagccgtataattgcaagtttattgatatctcaacttttacttttgggcttgcttagtacaaaaaaagcagccaattccactcctttgttagttatcttgcccatattgacattatctttccacaagttctgtaagagtcgcttcgaacctgcatttaggaggtaccctcttgaggaagccatggagaaagacatattagatcgaactacagaatctgatataaacttgaaagcatacttggctgatgcatatttgcacccaattttccactcatttgaggaagaagagttagttgaggttgaggttaaggttgaaagaaacaaatcgcatactgcaagtgatccaaccaccgaaatcaaccccccctctccaccacatcaagtcaaccatcctttttccccaccgcattacatgtatcatccttcttctccacctcagcatgtctatgagccttcctctccatcccattatgcctatcattacgaaaatgatatctaccatcctccctctccaccccattatgcctatcattatgaaaacgagccttgatattatggaggtactaatctacaagttcaactgctaacccttttttgtttttatttttctccaaatttctaatttccacg

SEQ ID NO: 489 - protein, 516 aa, Populus trichocarpa
MHVFDAHMFQMASERQKILEDSKSILPVSFVSFNSRWGAAVCAQTQQSKNPTLWLTNWAPEPRDIYWRNLAIPFVSLTVRKLIISLSVFALVFFYMIPIAFVQSLANLEGLEKVAPFLRPVIELKFIKSFLQGFLPGLALKIFLYILPAVLMIMSKIEGYIAHSTLERRAAAKYYYFMLVNVFLGSIIAGTAFEQLDAFLHQSPTQIPRTIGVSIPMKATFFITYIMVDGWAGIAGEILRLKPLIIFHLKNMFLVKTERDREKAMNPGSVDFPETLPSLQLYFLLGIVYAVVTPILLPFILVFFAFAYLVYRHQIINVYNQQYESAAAFWPHVHSRIIASLLISQLLLLGLLSTKKAANSTPLLVILPILTLSFHKFCKSRFEPAFRRYPLEEAMEKDILDRTTESDINLKAYLADAYLHPIFHSFEEEELVEVEVKVERNKSHTASDPTTEINPPSPPHQVNHPFSPPHYMYHPSSPPQHVYEPSSPSHYAYHYENDIYHPPSPPHYAYHYENEP

SEQ ID NO: 490 - DNA, 1421 bp, Populus trichocarpa
atttgtgagcttcttttgaagaaaaaaaaaatgatactttcagctcttttaacttcagttggaatcaatcttggactgtgcttgttgtttttcactttgtattcaatattgaggaagcaacctggtaatttttacgtgtatgcaccccgtttggtcgataaagagaaatctcagccacaggagagtgatgatttttacttggaaaggttattgccttctgctggttgggttagaaatgcttggcagctttctgaagatgaaatcttgtcaatttcgggtttagatggtctcgtgttaactcggatcttcaccttcagcttgaaagtgttcaccgttgctggggttattggaatctccatccttcttccaattaattattttgggaaccagctaagtgatgattttggccatttgccgaacaagtctttggattcatttagtatatcaaatgtcaatgacggttcaaacaggttatgggttcacttttctgctgcatatatttttactggagttgtctgctatcttctgtattacgagcataactatatgtcagcaaaaaggattgcttacttctattcatccaaaccgcagcctcatcagtttacaatattagtccgcagtatcccttcctcatctggaaaaaactttagtgaaactgttgagagttttttcacagagtatcatccttctacttatctttcacattcaatggttcatcgaacaagcaaaattcaagatctcattaatgatgcggacaaattgtatagaaagcttgactgcatgaaatcaaacaaccattctcagcaaaacttcagacgtgatggctttttaggactcactggacgcaaagttaatcttttagacctctatgaaaagaagttggaagatttggaagataatttgaggaaggagcaaaatttattggctggagaggaagttccagccgcttttgtttcattcaagtcgcggtttggtgctgcagtagccttacacatccaacagggggttaatcccacagaatgggtcactgagcgagctcctgagcctcaggatgttcactgggctttcttttctgcatcattcattaaaagatggatcttcaaactggtgaactgttgtcagtcaagtaattacaggatatcttccaagtctcattctgcagttatttctttcttttgttccaccaattatgttaacattttccgccattcaaggatacatttctcgcagtcaaatagaaagaagttcttgttccaagatgctatggtttatcatatggaacatcttctttgcaaatgtactgtcagggtcagctttgtatctagtcaatgtcttccttgagcccaaaaatattcccagggtgctagctgaagctgtcccaggtcaggtgggaatgcatctctgttctgtatattctttta

SEQ ID NO: 491 - protein, 436 aa, Populus trichocarpa
MILSALLTSVGINLGLCLLFFTLYSILRKQPGNFYVYAPRLVDKEKSQPQESDDFYLERLLPSAGWVRNAWQLSEDEILSISGLDGLVLTRIFTFSLKVFTVAGVIGISILLPINYFGNQLSDDFGHLPNKSLDSFSISNVNDGSNRLWVHFSAAYIFTGVVCYLLYYEHNYMSAKRIAYFYSSKPQPHQFTILVRSIPSSSGKNFSETVESFFTEYHPSTYLSHSMVHRTSKIQDLINDADKLYRKLDCMKSNNHSQQNFRRDGFLGLTGRKVNLLDLYEKKLEDLEDNLRKEQNLLAGEEVPAAFVSFKSRFGAAVALHIQQGVNPTEWVTERAPEPQDVHWAFFSASFIKRWIFKLVNCCQSSNYRISSKSHSAVISFFCSTNYVNIFRHSRIHFSQSNRKKFLFQDAMVYHMEHLLCKCTVRVSFVSSQCLP

SEQ ID NO: 492 - DNA, 2255 bp, Populus trichocarpa
ttttggaggttttgagattggtatgctgaaatgctcgtttccgctattctaacatcagtggggataaactctgctctatgtgttctattcgttgtactgtactctatactgaagaaacaaccaagttattatgaagtttatataccgcgcttgctgacggaagggaattctaaacggagaagccgtttcaaccttgaaaggctaataccatctactggctggttgcccaaggcatggaaactatcggaagaggaaatgttgtcttcttcaggcttggacgccgtggtgtatatgcgaactataactttctgtttgaaagtattttcattcgctgggataatagggatatttattcttcttccagtgaactgttcggggactgagcttcaccaaattgacttcgaagatttgtatagtaattctctggatgtattcaccatttcaaatgtaaatcgaggctcaaagtggttatggattcacttctcttctgtatatgctatcactattttcatctgctatctactttatcatgaatataactatatttcttcaaaaaggattgcgtatttttattcatccaaacctcagccacatcagttcaccatcttagttcgcaatatccctgtctcagctggaagcagtgtcagtgacagtgtcgagagcttctttaccgagtattaccctaccacatatctgtcacatatagttgttcgccgaactagcaaagttcagagcctcattaatgatgcaaagcaattatacaggaggcttcttcacttgcaatcagaaccatctgagcagaagtataagcaagttggattgtttgaaaaaaaggttgatcttttggatcattatgggaagaggttagaagacttagagcagaatgcgagattggagcaatctgaggtatcattggcaaaagacactcatgctgcctttgtgtccttcaagactcggtatggtgcttccactgttttccacctgcaacaatcaaccaaccccacacattggctcacagaagaagctcctcaaccaaatgacgtcttttggccttttttttcttcatcattcatgggaagatggatttctaagcttttggttgtagttgcgtgtattcttcttacaattttgttccttattcctgttgtagttgtacaaggtcttactaacctgagtcagctggaagtttggtttccattcctcaaaagcattctaaccttagcatttgtcagtcaaatagttacaggatatcttcctagtctgattcttatgttgttcctaaagatcgtgcccccaatcatggagttcctctcctccattcaaggatacatttctcatagcgagatagagaggagtgcatgcaacaaagtactctggttcacagtatggaacatcttcttcgccactgtattttccggttccgtgttaaatcagatttccattgctcttgatcccaagaatattcctacaaaactggctgttgttgttccagcacaggcatcatttttcattgcttatgttgtcacatctggatggacaagcacttcatcggaactttttcgcataatccctctaatttgcagtctaatgacgaagtgttgtgctgaaagtacagatgatgaaattgaagttccatctattccttatcacagggacattcccaggattcttttctttggacttcttggtattgcatatttcttcttagctcccgtcattctgcccttccttctggtgtacttctgtcttgcatacatcatcttccgtaaccagttcataaatgtatatgctcccaagcacgaaactgcagggaagttttggcctatcgtacacaatttggtgatattttctctggtactcatgcatgcgattgcagtgggaatcttttctctgaagaagctctctctcgcatcaaccttagtcttacctcttccagttctcacgcttctgtttaatgagtactgcaggaaacgcttcctccccatttttacagcttatccagctgagatattgataaagaaggacagggaagatcaaaatgatgctacgatgtctgaattttttgataaattggccaccacctatcaggacccggctctaatgccgattcagtactctgcagacagtgaaagtcttaacagaccgcttataccatctgctgaaatgtcaatgtgaggttgtctttgcactgtattgactattgagctgaatagtagtggtggtttctattatcaaccaccatttccatatgctac

SEQ ID NO: 493 - protein, 714 aa, Populus trichocarpa
MLVSAILTSVGINSALCVLFVVLYSILKKQPSYYEVYIPRLLTEGNSKRRSRFNLERLIPSTGWLPKAWKLSEEEMLSSSGLDAVVYMRTITFCLKVFSFAGIIGIFILLPVNCSGTELHQIDFEDLYSNSLDVFTISNVNRGSKWLWIHFSSVYAITIFICYLLYHEYNYISSKRIAYFYSSKPQPHQFTILVRNIPVSAGSSVSDSVESFFTEYYPTTYLSHIVVRRTSKVQSLINDAKQLYRRLLHLQSEPSEQKYKQVGLFEKKVDLLDHYGKRLEDLEQNARLEQSEVSLAKDTHAAFVSFKTRYGASTVFHLQQSTNPTHWLTEEAPQPNDVFWPFFSSSFMGRWISKLLVVVACILLTILFLIPVVVVQGLTNLSQLEVWFPFLKSILTLAFVSQIVTGYLPSLILMLFLKIVPPIMEFLSSIQGYISHSEIERSACNKVLWFTVWNIFFATVFSGSVLNQISIALDPKNIPTKLAVVVPAQASFFIAYVVTSGWTSTSSELFRIIPLICSLMTKCCAESTDDEIEVPSIPYHRDIPRILFFGLLGIAYFFLAPVILPFLLVYFCLAYIIFRNQFINVYAPKHETAGKFWPIVHNLVIFSLVLMHAIAVGIFSLKKLSLASTLVLPLPVLTLLFNEYCRKRFLPIFTAYPAEILIKKDREDQNDATMSEFFDKLATTYQDPALMPIQYSADSESLNRPLIPSAEMSM

SEQ ID NO: 494 - DNA, 1751 bp, Populus trichocarpa
ttctttttgaagagtaagtaggaaacttaaatgaattgtaatagccacgtcttggccagaggtagaggagtgagtgagcttgtctttcttccaaaattagctttttttctggtgaatcatccagatcattatctctctcaccaggtggtgtgcaatgctaacaatctagccagcttggtcaagaagaaggaaagcaaacagaactggcttgactactaccaaaacaattttgacctcaatttttactcttctctgctgtttcagactggctttcttgggctttggggggcaaaagtggatgcaattgatcatcatgtgtcggaaattgagaaactgtcaaaagaaatagcagaagatagggaaaagattttaaatgatccgaattctatcatgccagctgcattcgtttcgttcaagactcgatggggtgcagcgttttgtgcacaaactcaacaatcaagaaatccaactttgtggttaacagagtgggctcctgagcctcgcgatgtgtattgggaaaacttagccattccatatgtgtcactttctgttaggaggctgatagttggagtttcattttttcttgccttcttattcttgatccctattgcatttgtacaatctctagcaagcattgagggaattgagaaaaaccttccccttttgaagcctgttattgaaatagaatttatcaaatcagttgcccaaggatttctacctgggattgcactgaaactctttctcaccttcctgccgacagtattgatgatgatgtctaaattggaaggcttcatgtctctatcatctttggaaaggatatcagcaatgagatattacattttcatcattattgatgtgttccttggaagcatactcaccggggctgtgttcgaacagctaaattcttttatcaatcaaattcctgaaacaatcagtgtagctattccaatgaaagcaactttcttcataacctatttaatggttgatggatgggctggaatggctggagaaattctaatgctgaaaccactgataatttaccacttgaagaatatctttttggtgaagactgagaaagacaggcaagaggcaatggatgctggtagtcttggtttcaacaccagcgaaacccgtatgcagttatattttctgttggggcttgtaaacgcagcagtcacgcctattctccttccatttatagttattttcttcagcttttcttatgtagtattccgtcatcagatcataaatgtttacaaccaagagtatgaaagtggcgccgtgttctggccttctgtccatgggcgtattattactgcacttgtaatctcacagctgcttatgatgggactgttgagtacaaagcaagcttcccagtcaacaccatttgccattgctcttcctgaagcaatgatgaaagataccctggaacgatcaagttctctgaactttaatttcaaatcctaccttcagaatgcatatatccatccagttttcaaaggtggtgatgatgattgtgccgagtatctgagcgaaaagttagaaactgatagtgacagtgttttagtgcctacagttcgccaatcgcaaagaaatacaccagcaataagaagtagatcatcctcaccggctttatccgatgaagatagaacagtagagcctgaagtatgaaacttacaagccaacatctccttgcatggcatattgcaatgacatgagacagctggattaggcattacctttgtgtattt

SEQ ID NO: 495 - protein, 546 aa, Populus trichocarpa
MNCNSHVLARGRGVSELVFLPKLAFFLVNHPDHYLSHQVVCNANNLASLVKKKESKQNWLDYYQNNFDLNFYSSLLFQTGFLGLWGAKVDAIDHHVSEIEKLSKEIAEDREKILNDPNSIMPAAFVSFKTRWGAAFCAQTQQSRNPTLWLTEWAPEPRDVYWENLAIPYVSLSVRRLIVGVSFFLAFLFLIPIAFVQSLASIEGIEKNLPLLKPVIEIEFIKSVAQGFLPGIALKLFLTFLPTVLMMMSKLEGFMSLSSLERISAMRYYIFIIIDVFLGSILTGAVFEQLNSFINQIPETISVAIPMKATFFITYLMVDGWAGMAGEILMLKPLIIYHLKNIFLVKTEKDRQEAMDAGSLGFNTSETRMQLYFLLGLVNAAVTPILLPFIVIFFSFSYVVFRHQIINVYNQEYESGAVFWPSVHGRIITALVISQLLMMGLLSTKQASQSTPFAIALPEAMMKDTLERSSSLNFNFKSYLQNAYIHPVFKGGDDDCAEYLSEKLETDSDSVLVPTVRQSQRNTPAIRSRSSSPALSDEDRTVEPEV

SEQ ID NO: 496 - DNA, 2237 bp, Populus trichocarpa
tttgttttggtttttttgttgaaggtatcaatggcaacgctaggagatatagcggtttcgggggctttaaatctactgggtgctttcattttcttattggcatttgcaatcttgaggatacaacctttcaatgatagggtttactttccaaaatggtatctcaagggcttaagaagcagtgcctcgcactcgggggcttttgctcgcaggattgtgaatttagactttagatcgtatacccggtttttaaattggatgcctgaagcgcttaaaatgcctgagcctgagcttattgatcatgcaggattggattcagcggtttacttgcgaatttacttgatgggacttaaaatttttgtgcctatagcgttccttgcttgggctatcctggtgccagttaattacaccaatgatactctagagaaagcccagctggtgtccaatgtaactgctagtgacattgacaagctttcaatttccaatgttccacttaaatcacaaagattttgggctcatatagtgatggcctatgcctttactttctggacatgctacgtgttgctgaaggagtatgagaaaattgcttcaatgaggttgcaatttctttcctcagaaggacgccgtccagatcaattcactgtccttgttaggaatgtacctccggatccagatgaatctgtcagtgagcttgtggagcactttttcctagtgaatcatccacatcattatctcattcatcaggtggtgtgcaacgcaaacaaactagccagtttggtcaagaagaagaaaagtaagcagaactggcttgactactaccaactcaagtatgacaggaatcaatcacagcggcctcttaagaaaactggtttccttgggctttggggtgaaaaagtggatgcaattgatcatcacatatcagagattaagaaactgtcagaagaaatagaagaggagagggaaaaggttttaaaggatccaaagtctataatgccggcagcatttgtttcatttaagactcgatggggtgcagctgtttgtgcacaaactcaacaatcaagaaatccgactttgtggttaacggagtgggctcctgagccgcgtgatgtatattgggaaaacttggccattccatacatgtcactctctgttaggaggctgataattggagttgcattctttttccttactttctttttcatgatacctattgcatctgtgcaagctctagcaagcattgagggaatcgagaaaaaagccccttttctgaagcccattattgaaataaaatttatcaaatccgttatccaaggttttctacctggcattgcattgaagctcttcctaatcttcctgccaacaattttaatgatcatgtctaaatttgaaggcttcctatctatatcatctttggaaaggagatcagctacaagatattatattttcctcattatcaatgtattccttgggagcatactcgctggggccgcatttgaacagctaaattcttttatcaatcagtctgctaatgaaattcctaaaacaataggtgtagctgttccattgaaagcaactttcttcataacctatataatggttgatggttgggctggaatagctggagaagttctaatgctgaaaccactgatactctaccacttgaaaaatttctttctggtgaagacagaaaaagacagggaagaggcaatggatcctggcagtcttggttttaacaccggcgaaccccgcattcaattatattttctgctaggtcttgtatatgcaacagtgacacctgttctccttccattcataattattttctttgccttcgcctatgtagtgttccgtcatcagatcataaatgtttacaaccaagagtatgaaagtggtgcggcattctggcctgatgtccatgggcgtgttattactgcattagtaatctcacagctggctctgctgggactgatgagtacaaaagaagctgcgcagtcagcaccatttctcattgctcttcctgtactcactatatggttccatgggttctgcaacggacgccacaaatctgcttttgtcaaatatccattacagcttgatctttttgtcatgaagcatgaaatgcctagctgtgttgatgacattgtttgtttactgttgtgaaaagcttgatttgatgataatggaggaagagaaagaggaaaaattcaaccactttcttttcaaatgaaaaattttttagt

SEQ ID NO: 497 - protein, 708 aa, Populus trichocarpa
MATLGDIAVSGALNLLGAFIFLLAFAILRIQPFNDRVYFPKWYLKGLRSSASHSGAFARRIVNLDFRSYTRFLNWMPEALKMPEPELIDHAGLDSAVYLRIYLMGLKIFVPIAFLAWAILVPVNYTNDTLEKAQLVSNVTASDIDKLSISNVPLKSQRFWAHIVMAYAFTFWTCYVLLKEYEKIASMRLQFLSSEGRRPDQFTVLVRNVPPDPDESVSELVEHFFLVNHPHHYLIHQVVCNANKLASLVKKKKSKQNWLDYYQLKYDRNQSQRPLKKTGFLGLWGEKVDAIDHHISEIKKLSEEIEEEREKVLKDPKSIMPAAFVSFKTRWGAAVCAQTQQSRNPTLWLTEWAPEPRDVYWENLAIPYMSLSVRRLIIGVAFFFLTFFFMIPIASVQALASIEGIEKKAPFLKPIIEIKFIKSVIQGFLPGIALKLFLIFLPTILMIMSKFEGFLSISSLERRSATRYYIFLIINVFLGSILAGAAFEQLNSFINQSANEIPKTIGVAVPLKATFFITYIMVDGWAGIAGEVLMLKPLILYHLKNFFLVKTEKDREEAMDPGSLGFNTGEPRIQLYFLLGLVYATVTPVLLPFIIIFFAFAYVVFRHQIINVYNQEYESGAAFWPDVHGRVITALVISQLALLGLMSTKEAAQSAPFLIALPVLTIWFHGFCNGRHKSAFVKYPLQLDLFVMKHEMPSCVDDIVCLLL

SEQ ID NO: 498 - DNA, 2651 bp, Populus trichocarpa
attgtttctttcaagtgaagtgaacaggatatggcgacaataagtgatataggagtagcagcagctattaatatactcactgcatttgctttctttattgtgtttgcgattcttcggattcagccggtaaatgatagggtttacttccccaaatggtatatcaagggtttaaggagcagtccattgggcactggtgcgtttgtaggcaagtttgtcaatttggacttcaggtcatatgtgaggtttctcaactggatgcccgcagcattgcaaatgccggagcctgagctaattgaccatgctggattggactctgctgtgtacttgaggatttacttgacagggcttaaaatttttgttcctattgcattcctggccttcactatctcagtgccagttaattggacaaataacactctggagcattctactttaacttacagtgatttggataagctctctatatcaaatatacccacaggatcatgcagactgaatttgttatcttatgtttgcttttttatgaaaaaaataccaattaaagtggagggtttcttcaaacaacaaggggttgggtcaactattcaatcaaatgatattgagtatgtttccatctcttctcaagaaagaagtgggctatttctttgtaaaattgtgctcaatttcatatgtggcaattccggcaagaactcttcgttagttggggaaataatccgcagcctttgattctggacccatatggtgatggcttatgcttttaccttctggacatgctatgtgctaaaaacagagtatgagacagtggctaaaatgaggttgcattttcttgcatcagagaaacgacgtcctgatcaatttacagtactggttagaaatgtgccaccagatcctgatgaatcagttagtgaacttgtggaacattttttcctggttaaccatcctagcgattatctcactcatcaggttgtctacaatgctaatgaactttctaacttagtcaacaagaagaaaaagatgaagaactggcttgactactatcaaatcaaatattcaagaaatcaatccagaaagccttctctcaagactggtttccttggcctttgggggaatagggtggatgcaattgatcactacacatctgagattgagagactatcaagagaaatctccttggagagagacaagattgtgaacaatcccaagtcaatcatgccagcagcatttgtttccttcaaaactcgatggggagccgctgtttgtgcacaaacacaacaatccagaaatccaactatatggttgactgggtgggctccagaaccccgtgatgtatattgggataacctcgcaattccatttgtttcgctcacactaagaaggcttgttattgctgttgcgtttttcttcctcaccttctttttcatgattcccattgcatttgtacagtcccttgcgaacattgaaggaattgagaaagcactcccattcctgaaacctataattgaaatgaaagtgattaagtcattcattcaaggtttccttcctggaatagctttgaagatatttcttatttttctaccctcaatattgatgctaatgtctaaattcgagggattcattagtctatcaggcttagagaggagatctgcagctagatattatatcttccaattcgttaatgtgtttcttggaagcataatcaccggaactgcatttcaacaactggataattttatccaccagtctgcaactcaaataccaaagacagttggagtttcgattcctatgaaggcaactttcttcataacttacataatggttgatgggtgggctggagtcgctggggagattttaagattgaaacccttgataatctatcacctgaaaaactttttcttggtgaagactgaaaaggataagaaagaggcgatggatccaggaactcttggtttcaacacaggggaaccacaaatacaactttatttcctacttggcctcgtctatgcagtggtgtcgcctatcttacttcctttcataattgtattctttgccctcgcatttgttgtatatcgtcatcagattataaatgtttacaatcaggagtatgagagtgctgcagcattctggcctgatgttcatggacgcatcatagttgcagtaattgtctcacaactgctgctaatgggattgttaagcacaaaagaagctgctcagtccacaccgttgctcattacactcccaatattgacaatatggttccatttgttctgcaaaggccgatatgaacctgcttttgttagatatccattgcaggaagcaatgatgaaagatacattggaacgtgccagagagccaaacctgaacctgaaaagcttccttcaaaatgcttatagccacccagtttttaaaggcgaagatgatagcgacagtgatgaagcacccgaagagtttgagaaagaacctgatctggtcccaacaaagcgccagtctcgaaggaatacgccattgccaagtaaacatagtggttcagttccatcctcccagcgtgaagctcaggattatcctctactctgaaactgtttctgcgacatcaacttgtgtgtaaatgcgagtccttgggagattaaactggttgatatttcttcagcacagag

SEQ ID NO: 499 - protein, 846 aa, Populus trichocarpa
  UNSURE (232)..(232): Xaa can be any naturally occurring amino acid
MATISDIGVAAAINILTAFAFFIVFAILRIQPVNDRVYFPKWYIKGLRSSPLGTGAFVGKFVNLDFRSYVRFLNWMPAALQMPEPELIDHAGLDSAVYLRIYLTGLKIFVPIAFLAFTISVPVNWTNNTLEHSTLTYSDLDKLSISNIPTGSCRLNLLSYVCFFMKKIPIKVEGFFKQQGVGSTIQSNDIEYVSISSQERSGLFLCKIVLNFICGNSGKNSSLVGEIIRSLXFWTHMVMAYAFTFWTCYVLKTEYETVAKMRLHFLASEKRRPDQFTVLVRNVPPDPDESVSELVEHFFLVNHPSDYLTHQVVYNANELSNLVNKKKKMKNWLDYYQIKYSRNQSRKPSLKTGFLGLWGNRVDAIDHYTSEIERLSREISLERDKIVNNPKSIMPAAFVSFKTRWGAAVCAQTQQSRNPTIWLTGWAPEPRDVYWDNLAIPFVSLTLRRLVIAVAFFFLTFFFMIPIAFVQSLANIEGIEKALPFLKPIIEMKVIKSFIQGFLPGIALKIFLIFLPSILMLMSKFEGFISLSGLERRSAARYYIFQFVNVFLGSIITGTAFQQLDNFIHQSATQIPKTVGVSIPMKATFFITYIMVDGWAGVAGEILRLKPLIIYHLKNFFLVKTEKDKKEAMDPGTLGFNTGEPQIQLYFLLGLVYAVVSPILLPFIIVFFALAFVVYRHQIINVYNQEYESAAAFWPDVHGRIIVAVIVSQLLLMGLLSTKEAAQSTPLLITLPILTIWFHLFCKGRYEPAFVRYPLQEAMMKDTLERAREPNLNLKSFLQNAYSHPVFKGEDDSDSDEAPEEFEKEPDLVPTKRQSRRNTPLPSKHSGSVPSSQREAQDYPLL

SEQ ID NO: 500 - DNA, 2003 bp, Triticum aestivum
gcacgaggctgagagcagcggcaagatcaacatcagacgttaaaccagaggagtttgcaatgttggtgagagatgttcctgttccacctcctaatcaaactataaaggactcggtggactcgtatttccgagcacttcatcctgacacattctacaaagcaatggttgtgacagacatcacgaaggctgataaaattttccaagagattgaaggtcacaaacacaaaattgctcatgctgaagctgtctatgcagaatcaaaaacagcaaacagacctgagggcacgaggcctactcataggacaggattccttggccttatcggtaaaaaggtcgacacgcttgagtactgtaatgagaagattaaggaattgctgcccaaactggaggatgaacagaagagcacccttagtgagaaacagcaaagggcggcctttgtcttcttcaacagcagagctgccgctgcctctgcatctcagactctccatgctcagatgtttgatgaatggacagttacagaagctcctgaaccacgtgctgtaatatggaccaatcttccaaggaaaatatatgataggcaaaccagacagactgtggtctacctcattgtcttcgtcaccgtggttttttatatgattcccattactgctatctctgctgttacaacgctggaacaactgaggaagaagctgccctttctgaaggtggttgtggaccaacctttacttaagacagtcttacaagcttacctgccacagatcgccctcattgttttccttgctttgctgccaacacttcttgtgttcctgtcaaagtcagaaggaattccttcacagagccatgtagtaagggcatcatcaggaaaatatttctactttattgtcttcaatgtattcattggctatgcaattggttcctcattgttcagcgctttgcaaaaagtcatcgagaaccctactgggattgttacgacgcttggctccaggcttcctggaaatgcaactttcttcctcacatttgttgcactgaaattctttgttggatatgggcttgagctctctcgtttggtccccctcatcattttccacctgaaaagaaagtacctatgcaagacagaggatgaggtgagagcggcatgggctccaggagacctggggtataacacgcgggttccgaatgacttgcttatcgtgacacttgtgatgtgctactccgtcatcgcgcctttgattttgccatttggcgttgcttactttgctctgggttggcttatagcaaaaaaccaggttctgagagtttatgttcctatttatgagagcaacggacgaatgtggccacacatgcacacaaggatcattgcagctctcatgatttaccaggcaaccatgcttggtatcatcggcctgaagaggttctactattctactatccttgccccactcctcgcaataagcttaatctttgcctacacttgccatacacgcttttatcctgcattcgccaaaacccctcttgaggtggcaagtcagcagctgaaagagacgccgaacatgagcaccatttacaccgcttacatccctgcttgcctcaagcccgagaagctcgaagatgtggaagtctttgaagacgcgcagtcacgcaccacctccagagctccctctttttaatgatttgtgatgaatgtccacgtgctctggacggcctttccacgtcgaccacgctgtgaagctattgtttccaggataggaaactgatgtcatgtcccgtgtacatacatgcgctgttgcatgatgaacacttgttgaaaaacgtagtcttatatgttaggttgttgctgtggatattgttgggtgtttacgtttttctttttgctattatcgtgtgtagacaatctgctgccctggtgtgtaaaaatctcagaagtctgactgcttgatgccttttaaccctgttagcaaattatcccggtactgttactatttgttactgagatgtccatgctg

SEQ ID NO: 501 - protein, 535 aa, Triticum aestivum
MLVRDVPVPPPNQTIKDSVDSYFRALHPDTFYKAMVVTDITKADKIFQEIEGHKHKIAHAEAVYAESKTANRPEGTRPTHRTGFLGLIGKKVDTLEYCNEKIKELLPKLEDEQKSTLSEKQQRAAFVFFNSRAAAASASQTLHAQMFDEWTVTEAPEPRAVIWTNLPRKIYDRQTRQTVVYLIVFVTVVFYMIPITAISAVTTLEQLRKKLPFLKVVVDQPLLKTVLQAYLPQIALIVFLALLPTLLVFLSKSEGIPSQSHVVRASSGKYFYFIVFNVFIGYAIGSSLFSALQKVIENPTGIVTTLGSRLPGNATFFLTFVALKFFVGYGLELSRLVPLIIFHLKRKYLCKTEDEVRAAWAPGDLGYNTRVPNDLLIVTLVMCYSVIAPLILPFGVAYFALGWLIAKNQVLRVYVPIYESNGRMWPHMHTRIIAALMIYQATMLGIIGLKRFYYSTILAPLLAISLIFAYTCHTRFYPAFAKTPLEVASQQLKETPNMSTIYTAYIPACLKPEKLEDVEVFEDAQSRTTSRAPSF

SEQ ID NO: 502 - DNA, 4926 bp, Volvox carteri
gtccccctcaacagttacaatttaaaatgttgtttacttttctgaatctcaaaatgcataggtgtagcacacatgctggtggctaatgcaagccagtgtttgaatatcctcttggtcgcaatagcgaagattaaggacatgtcagacaagagcgttgtgaacactgcgttgggcaggattatcggggtgaagaaccaggtgtcggatacgaccattataaccggtttatggatctcaggcgtagtcggcactgcagtcatcatactcttttgcgtgcttcaacgcgtgagcctgctgtacaagtaccggttggttgccaaccatgtacgggtcaagcccccaaagctgcgggagcgcggtctcatctccttcattgattgggccatcaagtcgatatcggtgtcggatgtggacttcattctctcggccggactagatgcgctgatcatggtgaagatctgtgcgctaggtgtgcagctgtttctacccctatgcattctgggaaccgcagtcctcatcccgttgcactggactgggggcgcctccaaacagctggacgcttaccagagcggattcatgcgcctcacaatgtccaatatcccgcatggctccaaggtcttttgggtgcatctgggttttgtctacatctacctgggatgggctatggtgctgctacactggcattaccaccagtacctcaccattcgccagcactacctgcggaaaggtgatgacgtaaatctgtggcgggctctgtacgaagagcaaggacggccggatccgccacagggcaaggaacctaggggctcggaattcatcaacggcctcttgcgcagcgtgcagctgatcaaggcactcatgccgtcgggcgtgcctgtcagcgggcccacgtccctgcctgcagacggccgggacgaggaggatgaagatgaggaagaggacgagggctttgcgatgggtggcatgccattgccgttggagttgaggaggacgaccctgggaggcctggacccagttggggcccggtcgccgaggggctctgtggacgggtgcggacgcgtggtacacgtgcgaggacatggggatctttgggcgggggagtggagccaaagccgcgtactgcagctctcgggggcgcatgacgcaccgacggccgggtcggggacctcatcaaggctgtcccgccggactctggcccaagcaatccgcaaccgcgttaccggctctggaagcaccgtgttgcgggcctcgggggcacaagaccatggcagcagactcatccaccgggccgcctacagcatcggaccccgcgcggtggcggcccctagcgaccaggcgctgcagcacatgcgaccacagctcagccttgaccgcggaggcaggcggggcatgtcgccggcccgagggcagtcctacttgaagtcaagcgagccggtcagccttcagctgaaggaaagcagtgacgccgctgccggctgcggcctcggtcaggagggggctactgatctggaggcggggctgggccgcagcgttctgggtgcggactcgcgctctttggccccaagcccttgctccatagatcgcaaagggtcgggtctagactctgatgcgcacctgcttgagtggtggctggagcgtccggaagcgaccgtccagtcgcgctcacgtgcgctgcgggcgcagctggagaaggcgctgaacgggcgcgacatggacttgaaacggcccagcgtgggccaccgcaagacggtgaatgcggagttctcggacggcacgcgcgtggcggtgctggcgcagcactacgcggtgctggtgacggacgttacatcgcgcagaccgcgactgagcaggcggaacagcaggggccccgctcagcctacgttggtaacgctgcctggcagcgaggccgctgacgccgtcactgaagtgcaggttaccggtcgtcgtccagctggatgctgcctacctccatggctttggagctggtgtgacctacagtacggtcaccaagccgcccgcaagctcaaccccaagcttccggctactctgtctgaggagctcctcgcgccggtccccagcggtgccaaccgcaccattgcgagcatgacggcgctcgcccgtgggtccactccataccactgctccccccggggctcgggggatggccgtgtcgtgccagctctgctgagtggtaaccgcacatgcagcgtcaatacgccctcgcatgcgcagcctctctctgcgctacagaccacctcaaccgcgggtcgtatcgacctgaatcccgactcatcaccgaagatggccggtcggtggcaccaggcagtgcgcggtgcagcgttgctgggccgggccccgcaggggggcacttggagcggcagtggcagtggcagcggcagcgagagactgattcggctgctggagatgatggcccgggaggcgcagggaaagctcgcggcaatgagcacagggatcgtatcggccaacccgtcattgagtcgcggcagtcccagcagtcatcacaccggcaccggctctggcactggtacgagccacccggtgccgacgtcgtctgtcagggctgtggctctgcccaggtcctttggtactggcccctcatcatcacaccagcagctacagcaccagggggtgccgcatcggttcacggagccaggtcccgcagcagcagctgctagtggcggacaggccgcggcgcgcagaggacaggcagcaagcccgagggcaggtagcggccccatcatcatctctccaagggtaccggtaggcgcatcgcttcgcggggtggcggcactgggacagcgggagggcccaagcaccagcggcacaggcgccggtccggtggcagaggcgtcgttggagattcgtgaagagggccaagccggggacgctgccgggagtgagggcgtcatccaggagggtaaccacgtcgccggcagcgcaggtgcctcggcggccgctggcgtgggtgccggtgcggggcaggatggcgggcgaacggtagtagatgcagcgacgtcgcagcgtcaggaaggctcaccaccaggggacgaggtggaagccaatccggtatcccagcagccaaccgaacgcgaacgcctgcgcgccgctgcgcttgccggatgggaggttgtacggcaggcggtgtgggacggccgcgtggcggagctgccgtggcggtaccgttactcggtggtttccgccaccttcctgcggctgttccccgaggagtttgaccgcgccatccaggtcgtcaatttcaaggaggtggacctgctgctgatggaagtggacaagcacatggcgcaatacgagtatgccatcaagtacgaggaaaagaccgggaagccgctgtacgggtgtcttgggttttgcgggctggtgggggagcggtgcagggtgcgcgaccaccaccgcgacaagatcaacgacctcctggtgcaggttcggaaggcgcgagtggcggctgccaacaaggcgcacacgccgtcctggtttgtgtttttccgcacccagcgcgccgccgccatggcgtctcagtgcatcatccacgcggaggacaaccggcagttccgggtgcaccccgctcccggccctgacgaggtcaactggtcggccctctggtccaacttccgcgaccgcgacctgcggcgcaacctgatgcgcccgctggtggtgctcatggtcgccttccccatcggcatattcaccgggggtgttactcagctggactacctgctgtgtccggcacacctctgcgtggggttagagagcggctccgaagactgggttgcggcgggctgcacggacgacatcaaggagcgggagagcgcggatatcaagacaaggtgcacattggctgggaaaacgctgtttggtgtggcgcatgcgccgagccagcagctgtcctgggagtggtactgcggacagaagaacccaattgcgaggctgctcaagcggctggtggtggcctggctgccctccctgctgctcatcctgtggcagggcatggtgctgccgctgttcttcacattcgtggtgcagatcagtcgccaggcccggtctctatcggaggccgaccgctacatcgccaagaacatgttttatttcggtgtcttcaacgttttcctgggcggggtggcgggcagcaccatcattcagggtatcaactcggccattgagaagggcccaagtgaaatcttcaatttggtcggcacatacgtgcccacctcgtccaacttcttcatcaactacaccatgtttagggtttttgtgtccgtcccggtgcgcatgctgtggccccacatcggaatccgcatgtacctcatccggcggtacctgcggctctcgtgcatcatcacgcgtcgcgaaagggccttcctcatggctccggtgtcgccgcgatatgggttcgaggtgggcatggtgatgataatcttcctgattgccttcgcctttagcgtggtgtccccgcttctgatgcccatggcgatgctcttcttcgccatctcctggctcttctggcgctgggcgctgctctacgtctacgtacgcaagtacgagggtggcggcaccatgtggcctttcgtcttcaaccgggtgctggtctgcctggccatcttccccgccttcacggcatgcgtcttcgtcacgaagcacgcgtatgcacaggctattgtgctgctggttaccgtccctgtcatcctggtccgctttcacaagtactgctactacaggttcgagacgggtctccaggcaatgccgctggaggccacggtggcggccccacccgctcgcgtggagccctgggtgtacacgccgccgccgttgctcagcaacctggccgggtggcaccccgactggtccaagtgctggatgggctggaacatgcccgtcatgtacgggtaa

SEQ ID NO: 503 - protein, 1617 aa, Volvox carteri
MLVANASQCLNILLVAIAKIKDMSDKSVVNTALGRIIGVKNQVSDTTIITGLWISGVVGTAVIILFCVLQRVSLLYKYRLVANHVRVKPPKLRERGLISFIDWAIKSISVSDVDFILSAGLDALIMVKICALGVQLFLPLCILGTAVLIPLHWTGGASKQLDAYQSGFMRLTMSNIPHGSKVFWVHLGFVYIYLGWAMVLLHWHYHQYLTIRQHYLRKGDDVNLWRALYEEQGRPDPPQGKEPRGSEFINGLLRSVQLIKALMPSGVPVSGPTSLPADGRDEEDEDEEEDEGFAMGGMPLPLELRRTTLGGLDPVGARSPRGSVDGCGRVVHVRGHGDLWAGEWSQSRVLQLSGAHDAPTAGSGTSSRLSRRTLAQAIRNRVTGSGSTVLRASGAQDHGSRLIHRAAYSIGPRAVAAPSDQALQHMRPQLSLDRGGRRGMSPARGQSYLKSSEPVSLQLKESSDAAAGCGLGQEGATDLEAGLGRSVLGADSRSLAPSPCSIDRKGSGLDSDAHLLEWWLERPEATVQSRSRALRAQLEKALNGRDMDLKRPSVGHRKTVNAEFSDGTRVAVLAQHYAVLVTDVTSRRPRLSRRNSRGPAQPTLVTLPGSEAADAVTEVQVTGRRPAGCCLPPWLWSWCDLQYGHQAARKLNPKLPATLSEELLAPVPSGANRTIASMTALARGSTPYHCSPRGSGDGRVVPALLSGNRTCSVNTPSHAQPLSALQTTSTAGRIDLNPDSSPKMAGRWHQAVRGAALLGRAPQGGTWSGSGSGSGSERLIRLLEMMAREAQGKLAAMSTGIVSANPSLSRGSPSSHHTGTGSGTGTSHPVPTSSVRAVALPRSFGTGPSSSHQQLQHQGVPHRFTEPGPAAAAASGGQAAARRGQAASPRAGSGPIIISPRVPVGASLRGVAALGQREGPSTSGTGAGPVAEASLEIREEGQAGDAAGSEGVIQEGNHVAGSAGASAAAGVGAGAGQDGGRTVVDAATSQRQEGSPPGDEVEANPVSQQPTERERLRAAALAGWEVVRQAVWDGRVAELPWRYRYSVVSATFLRLFPEEFDRAIQVVNFKEVDLLLMEVDKHMAQYEYAIKYEEKTGKPLYGCLGFCGLVGERCRVRDHHRDKINDLLVQVRKARVAAANKAHTPSWFVFFRTQRAAAMASQCIIHAEDNRQFRVHPAPGPDEVNWSALWSNFRDRDLRRNLMRPLVVLMVAFPIGIFTGGVTQLDYLLCPAHLCVGLESGSEDWVAAGCTDDIKERESADIKTRCTLAGKTLFGVAHAPSQQLSWEWYCGQKNPIARLLKRLVVAWLPSLLLILWQGMVLPLFFTFVVQISRQARSLSEADRYIAKNMFYFGVFNVFLGGVAGSTIIQGINSAIEKGPSEIFNLVGTYVPTSSNFFINYTMFRVFVSVPVRMLWPHIGIRMYLIRRYLRLSCIITRRERAFLMAPVSPRYGFEVGMVMIIFLIAFAFSVVSPLLMPMAMLFFAISWLFWRWALLYVYVRKYEGGGTMWPFVFNRVLVCLAIFPAFTACVFVTKHAYAQAIVLLVTVPVILVRFHKYCYYRFETGLQAMPLEATVAAPPARVEPWVYTPPPLLSNLAGWHPDWSKCWMGWNMPVMYG

SEQ ID NO: 504 - DNA, 3519 bp, Volvox carteri
atgtgcagatatgctaaggacatcgaccttaagcccaagcggctaccaaatgggctgcttagctggatctaccccgtcattacatatcctgagggggatattatcgacgaggctgggctggactgtgcgatgtatctgcgcattctccgtttcggggtgtacctattcttccccctcacgatcttttgcatcatcgtggtgctcccgcccaacatgaagagtaacggaattgaggcaatcctcgcggagcaggctttgcgaaatgccggcaagaaccagacctcgggcaaaggcgacttggagttctccgatttcgaccattactcgctgtccaacgtcgaggccgccagtcccaagatgtgggcacacctgttcgctgtgtactgtgtggtgctgtacaccctctggctgctgtggcggttcaaccgcgagtccgtgttgctgcggctactcttcctgggtaatgcgaaacgcggagggccctctcacaccgtgttggtgacggatattccgggtattagtgaggctgtttccaaggccctacgggacgagcgggcgaagaagcaggagatgaagaagatggaacgagataaatctattatctcgcagaagagtgtggacgtgcagctggacgacgacagctacgcagagctccccgaccagccgcggaccgccaccaccagcgtcgccagcaccacgctgaagccccagacctcactgcgcaagggccgggtggtctccatcagcgaacccccggtgcttgtagtccaacaacaacagctgcaacaacagcagcagcagttcacgccgcgtgccgtgccgtcggtggagaagggcggccggtcgaacgtatcagcatcgcccttctccgacgccagcgccaagagctttgagagtactgcagacgccgagctgccaggatcctccacgaaacccgaggttgtcgaattaaagagcgccgcctcggcctctggcggcgccgctgctggcggcggccccgccggtcccgccgggggagcttcctttgttgttaaggccggcgggaacagtcgctttaacttgcgcagtatcctgagtagcaccgctagcgacgcgcaataccggctggtggtggatgacctggaccccaagtacgcggccacgggcggcaagttggagttggcgcgcgttggcaagacgaacgaggagatccttaaggagttgcaggtcatggagaaggacgatttggtcaagggccttcccgagaagctgggggtggatacgaggccgctgcctcccacccgccgcaacaccaagcgttatgagtacgacctgaaaacaacggtgctggatcccgtacatgaggccctggagacattgaggaaaggcgtgactccacagcaattggtggcccgagagtttgcgttggtgtacggcacgagcaatgtggccgcggtcaacatgattcaggacacgagcgcgttggagcctctggctgaggaatacaaccaggcgcgtgtgtgtcaggacctggacgactacctggaaatggccaaactgcgactcaagctgcggaaggcgctgccgcagaagcagatctccatcctatgtgctcggtaccaggacatggactatgtgaagaagtttaagacgaagtggtttgtcaaggtggacgccgtggagttctggttggagcgcatgaagtacctccgggagcgtattaaaattgagcaagccaagtgtgtccgcaagatggcgccctccgccttcgtcaccttcaacactcgcatggctcaggctgtcagcgccaactcgctacactcccacgacgaaaacgcctggcgggtacagaacgcccctgcgccgtttgaggtggtgtggaagaacctgtcgctaacaatgcccatcaagaacggccggctgtacctcctgtgggctgctttctggggcatgaccatcttcttcatggtgcctgtgtccttcattcagggcatgattgaggttcccaagctggcctccattcccgtgctgggcgacatcgtgaccaccccgcccatcaagcagctgctgcaggctgtcattccaggtctggtgctcaagatcttcctggcgcttgtacccaccatcctgcgcatcatggcgcagctgtccggcgccacctccgtcagcgagatcgactttggagtcgtgaagcgcttcttcctgttccagacggtggtggtattcttcgggagcatcattctcggctcctttttcaaccagctgaagcagtgggtgaaggaacccagcagcgtcatcgccacactgggcaagtccatccccatgacctccacgttcttcatcacttatcttctcgtgaacggtctgggtgtcaagtcgtttgccttcattcggctgcccaactttgttatatattggatcttgtccaagttcgcgggtagccccgcggcccggcagcgcatgtggatgttccaatggaccaataacggcaccacggtggtggatcacaccatcgccatgatgctgggactgaccttctcctgcatcaaccccatcgtgtgccccgctgcgctggcgtacttcttggtcaatttcctaggggaaacgtacaacaacgtgtacgtgtaccgccgccagtacgagagtggcggcatgctgtggaagacggtttacaaccaggtgatggtggcgctgtacatcatgcagatcaccatgctgggcctgctgtccctcaagaagttcaaattcagccctttcatgtttcccctcatcatcttttccatcacctcgcacatcagcacactgcagctcttcaacaggccctggtcggtgacggcgctccacgacgccgcttacatggacatgttggaggcggaccagcggcggatgacactgctggcagctgcacgcgaggaacgcaagaagaagcgcgacaagattaagagggcgtacgacgatgccgtacgccaagccgagaacaacgacgacccgccgccaccgtacgacaccaggctggacgaggttccgtcgcccggctaccccggcgcgggtaaggccgaacttctgctgctggaatccatcgagggagatggctacgcacttaactcccaggagaagcgtgaagtggaggagatgtacatgaaccccgtgttcaaggtgaagctcgaagaggttgaacgcttggagaagctcgctgaggatgtgcagactcgcctgccgcgtttgaacgagtgggtggcggagtacaaggtgtaccgtcgagaggtgaagaagcgacacatcaagggcgacactgagcaggtgacgccgcccaagatgccggaggacctcaccatctacgacgcagacccgaacctgcaggacagtgatgatgaggaggatgcggggggcgcagctggcggcaaccctaacagcaccaccaacaacaacaagaacgataccgccgccgccggcggcggcggcggcagcggcagcctcagtttgcgcggcttgaagcagcgggagaccgggaaggaggttgatgctgctgaccgtgtctag

SEQ ID NO: 505 - protein, 1172 aa, Volvox carteri
MCRYAKDIDLKPKRLPNGLLSWIYPVITYPEGDIIDEAGLDCAMYLRILRFGVYLFFPLTIFCIIVVLPPNMKSNGIEAILAEQALRNAGKNQTSGKGDLEFSDFDHYSLSNVEAASPKMWAHLFAVYCVVLYTLWLLWRFNRESVLLRLLFLGNAKRGGPSHTVLVTDIPGISEAVSKALRDERAKKQEMKKMERDKSIISQKSVDVQLDDDSYAELPDQPRTATTSVASTTLKPQTSLRKGRVVSISEPPVLVVQQQQLQQQQQQFTPRAVPSVEKGGRSNVSASPFSDASAKSFESTADAELPGSSTKPEVVELKSAASASGGAAAGGGPAGPAGGASFVVKAGGNSRFNLRSILSSTASDAQYRLVVDDLDPKYAATGGKLELARVGKTNEEILKELQVMEKDDLVKGLPEKLGVDTRPLPPTRRNTKRYEYDLKTTVLDPVHEALETLRKGVTPQQLVAREFALVYGTSNVAAVNMIQDTSALEPLAEEYNQARVCQDLDDYLEMAKLRLKLRKALPQKQISILCARYQDMDYVKKFKTKWFVKVDAVEFWLERMKYLRERIKIEQAKCVRKMAPSAFVTFNTRMAQAVSANSLHSHDENAWRVQNAPAPFEVVWKNLSLTMPIKNGRLYLLWAAFWGMTIFFMVPVSFIQGMIEVPKLASIPVLGDIVTTPPIKQLLQAVIPGLVLKIFLALVPTILRIMAQLSGATSVSEIDFGVVKRFFLFQTVVVFFGSIILGSFFNQLKQWVKEPSSVIATLGKSIPMTSTFFITYLLVNGLGVKSFAFIRLPNFVIYWILSKFAGSPAARQRMWMFQWTNNGTTVVDHTIAMMLGLTFSCINPIVCPAALAYFLVNFLGETYNNVYVYRRQYESGGMLWKTVYNQVMVALYIMQITMLGLLSLKKFKFSPFMFPLIIFSITSHISTLQLFNRPWSVTALHDAAYMDMLEADQRRMTLLAAAREERKKKRDKIKRAYDDAVRQAENNDDPPPPYDTRLDEVPSPGYPGAGKAELLLLESIEGDGYALNSQEKREVEEMYMNPVFKVKLEEVERLEKLAEDVQTRLPRLNEWVAEYKVYRREVKKRHIKGDTEQVTPPKMPEDLTIYDADPNLQDSDDEEDAGGAAGGNPNSTTNNNKNDTAAAGGGGGSGSLSLRGLKQRETGKEVDAADRV

SEQ ID NO: 506 - DNA, 3390 bp, Chlamydomonas reinhardtii
atgcgcttgcgtccgtgggccaagcgcttctttggccccagaagatacgccaaagatgtggacataaaacccaagcggctcagcacagtcctgatgggctggataaagccggtgatgctgtacaaggaggaggacattattgatgaggttggtctggatgcggccatgtacctccgtgtggtatggttcggcatggaggtgtttttcgtgctgacgctggaggaagcattgaacggcaacacaaccgtcaccgccaacaccaccatctttgccagggacctaacggtgtcgtaccccatctcggccggatccagcacgctcgagacccactcgtacaccaacgcccgcatcaccttcaacggtacctcaaccgacctgttgctgaaccagacgtacaactacgtgatcgccggtaacggtacggcaaacttcacgggcacaaatgtcgacaccggcgtcgtgacgtacatgttcttgcgccagaccgtgctgagcgtgagctcgccctcgctcctggcgactggtgcccggaccataccaaacggcacggttttcaaccagaccaacgaggaggtcttgctggtggcgctcacctcgcccaactccgacacgtccgtgacggtcaacggccagcagttcaagttcaccaacttcgaccgctactcgctgtccaacgtgtcaccgggcgatgaggtgatgtggtgccacatggtcgccgtctacatcagcgccatcttcgtgctgtggtcggtgtacctgcggctgcttttcctgggcaacgccaaacgcggcggccccagtcacaccgtgctggtcaccgacgtgccctacgtcaacgaggcccccagcatgaagcaagccgccaagacgggcgcgggctctgttgcgggcggcggtggcgatggaccggagggcggcaaggcccccggccctggccccgagggcgcggggctggcgtttcggctaaagatgttaggcgaggatttggacgagtgcatgaaatacagattggaggatccctcgatcgatcctgccttcgccagcaccggcggccagctggaggcgccgcgcaccggccgcaccgccgagcagctgctggcagatctggagcgcgaggagcccgagcccacgtggctgcctccggggtacggcgtcgacacgcgtgtgctcaaacccgaccgccgcgcgctcaagcgattcaggtatgacgtgaagacgatgaaggcccgcaacgagatcaccgagaccggcaagaagggcccggtgggcgcagtcaccatggacccaatttaccaggccaggtcgaagctgcagtcgggcctgacgccgcagcagatggtggcgcgggagttcgcgctggtgtaccagccctacaacatcgccgcagtcaacatgatccaggtgatgcagtcgctggaggactacctggacatggccaagctgcgactcaagctgcgcaaggcactgccggtggccgaggtgcgcatctggcccaagctgcagggcgagggcgtgtggccgcgggtgcggctggagatgacccgcgtgctgcgggcgcagtggcacgcgctggatgaggacgtgacggctgaggaggacccgcgggacaaggccccaactaacggtgtgtgtgtatgtgtgtatggaaacatgcgagggggcggcggcgggaagagatccggctggaccagctcggcaaggaccgtggacgcggtgacgtactggcttgccaagctcaagtacctgcgggagcgcatccgcacggagcaggcggtggcgggtcgcaagctggcgcccagcgccttcgtcaccttcaacacgcgcatggcccagggcgtggcctccaactcgctgcacgcacacgacgagaccgtgtggcgtatcagcggcgcacccgcgcccaacgaggtggtgtggcgcaacctgcccatgacgcaccccgtgcgcagcggccgcctctacatcctgtggatcctgttttggctcatggcgctgttcttcatgatccccatctccgccatccaggcgctgatcgaggtgcccaagctggcgtccgtgccggtgctcggagacattgtcacgatcgactttggcgtcgtcagccggttcttcctgttccaggtcattgtggtgttcttcggatgcatcatcgccggctccttcttcaaccagctgaagcagtgggtagaggaccccgcctcggtcatctccactctgggcaaatccattcccatgaccgcaaccttcttcatcacctacctcttcatcaacggcctgggcgccaaatccatcgccttcgtgcggcttcccggcttcatcattttctggatcctgtccaaattcgctggatctcctcgcgcccgcgagcgcatgtggatgaaccagagcgcgcggtacggcatcctggtgccggaccacaccatggccatgctgctgggtctggtgttttgctgcatgaacccgatcgtgtgccccgccgccctcgcgtacttcattgtggcgagtgtgggcgagcggtacaacttcatctacgtgtaccgccaggtttacaaccagattatggtggggctgtacatcatgctgctgaccatgtttggcctgctcgcgatcaagaagttcaagtgggtgttcttcctgctgcccatcatcgccgccgccgtcatcagccacatggctacactcagcttatacagccggccttggtcggtgactgcgctgcacgacgcggctgagatggacatgctggaggcggaccagcgccgcgagcagctgctggcggcggcccgagaggtgggcggggagcgcaagaaggccaaggaggcgcagcggcggcgctacgaggaggcctgcatcgaggcggagaaggccgacgcagaggagctgcccaagcgggaggagttcttcgtgccgctcacccccggcccggcggagctgctgctcaaggagtccctgcgcggcgacggctttgcgctcaacagcgcggagaagaaggagatcgccgacatgtaccgcaaccccggcttcacgatggcactggagcagattgaggaggtggagaagctggcccgggtggttcagctgctgctgccgccgctcaaccagtttgtgagcgagtacaaactctacaggcgcggcgtgaaggcttccaagctcaagggaagtacggaggacgggccggaggcgccgcacatgcccgaggaccttacgatcttcgacaacgacccgcgcctggtcgggctggaccgcgagctgggcgagggcggcggcggcggagacgaagacgaaacgtccagtctgggggagcgcgacagcgccggcggcctgcgcgatggggagctggcgcccgtgccggtcgcaaggtcgcagtcgcaggcggctcggcgcaagtga

SEQ ID NO: 507 - protein, 1129 aa, Chlamydomonas reinhardtii
MRLRPWAKRFFGPRRYAKDVDIKPKRLSTVLMGWIKPVMLYKEEDIIDEVGLDAAMYLRVVWFGMEVFFVLTLEEALNGNTTVTANTTIFARDLTVSYPISAGSSTLETHSYTNARITFNGTSTDLLLNQTYNYVIAGNGTANFTGTNVDTGVVTYMFLRQTVLSVSSPSLLATGARTIPNGTVFNQTNEEVLLVALTSPNSDTSVTVNGQQFKFTNFDRYSLSNVSPGDEVMWCHMVAVYISAIFVLWSVYLRLLFLGNAKRGGPSHTVLVTDVPYVNEAPSMKQAAKTGAGSVAGGGGDGPEGGKAPGPGPEGAGLAFRLKMLGEDLDECMKYRLEDPSIDPAFASTGGQLEAPRTGRTAEQLLADLEREEPEPTWLPPGYGVDTRVLKPDRRALKRFRYDVKTMKARNEITETGKKGPVGAVTMDPIYQARSKLQSGLTPQQMVAREFALVYQPYNIAAVNMIQVMQSLEDYLDMAKLRLKLRKALPVAEVRIWPKLQGEGVWPRVRLEMTRVLRAQWHALDEDVTAEEDPRDKAPTNGVCVCVYGNMRGGGGGKRSGWTSSARTVDAVTYWLAKLKYLRERIRTEQAVAGRKLAPSAFVTFNTRMAQGVASNSLHAHDETVWRISGAPAPNEVVWRNLPMTHPVRSGRLYILWILFWLMALFFMIPISAIQALIEVPKLASVPVLGDIVTIDFGVVSRFFLFQVIVVFFGCIIAGSFFNQLKQWVEDPASVISTLGKSIPMTATFFITYLFINGLGAKSIAFVRLPGFIIFWILSKFAGSPRARERMWMNQSARYGILVPDHTMAMLLGLVFCCMNPIVCPAALAYFIVASVGERYNFIYVYRQVYNQIMVGLYIMLLTMFGLLAIKKFKWVFFLLPIIAAAVISHMATLSLYSRPWSVTALHDAAEMDMLEADQRREQLLAAAREVGGERKKAKEAQRRRYEEACIEAEKADAEELPKREEFFVPLTPGPAELLLKESLRGDGFALNSAEKKEIADMYRNPGFTMALEQIEEVEKLARVVQLLLPPLNQFVSEYKLYRRGVKASKLKGSTEDGPEAPHMPEDLTIFDNDPRLVGLDRELGEGGGGGDEDETSSLGERDSAGGLRDGELAPVPVARSQSQAARRK

SEQ ID NO: 508 - DNA, 4328 bp, Chlamydomonas reinhardtii
atgctggggctgttcacgctgttcacaatcgttcgtgtgaggccatgggcgaagcgcttctttgcgccaagaagatatgcaagagatgtagacttgaagccaaaacgcatgagcagcttctacctgggatgggtgaagcccatcatgttgtataaggaggaggacatcattgacgaggtgggcctggacgcggccatgtacctgcgggtcctgtggttcggcatggagctgtttttcatgctgacgctcatttgcatcccgctcgtcctgcccaccaacatgaccagcggggagatcgagcggctgctggcacaggcggaggaggctcaatcgctggttttgaataattcggtggttgtgcagccgcgcaataccagcctcctcggcgatgacaaccacaacgacgtccgcttcatgtacatgtcccagggcacggtggtcgccaacaacatggctccttggaacacgagcatcacgttcaacgcgacgatggtggaaaacaacgtcacgtttgtgcaggacttcttttccaactacagctgcaaggacacagctgagccgtacctatcctttgcggcgtacaacatgacttacgtacgcatcagcggcaccaaacgctacaacaacgactcgctaacagtcctgctgaaggacgcgatcgtatttctgggctggcaaaacatgagcgtcattcccgccagcctgcaggccgtgaataactcaggctttgattacatcatcgtgtggtcgctggagggcgaaacggagcagacgcagctgacggtcaacggcaaggagttcaagtttacaaattttgacaagtactcgctgtcaaacattccagccggcagcgccaagatgtgggcgcacgtggtagcgctgtggcttgtgacgctgttcactatgtggcgcctgagagagtacaacttacagtcggtgtatctgcggctgctcttcttgggtaactccaagcgaggaggcccctcacacaccgtcctggtcaccgacgtacccttcgtgtctgacgcggttgcgtgcggcctgcgcgcagaggagtaccgtgagaagcacggcctgcccgcgagcgtgaccagcctgaagaagagcatgagcatcaagaaccccatgtatgagggttacgagtcgctggagggcggccccgacggcaggacggcggtgggcgtgcccgtgtccaccagcgcgggcgagccgcgcctgcccggcaccaagtccgtcaccatcgtggaacccggcggcaagaacggcgccggcggcgcggcacagcagcctgccagctcgctacggtcgtcgcaggcggcgtcgctgaagcagtcgcaggcgggcgcgctcaaggtccacaccaccaacggcggcggcgcgtacgcggcggagacgccgcgcgccaacggcggcggctccactgcccagtccggcgacatgcgcgtgtcggagttcgcctccgccacctacgaggccgagtcagccgccggaggggacaagcgctccgccgccggcgactctggcgtcggcggcaaggagggcggcgccgtggtccaggccgtgggcgtgcccatcgaggagtgcctcaagtaccggctgcacgaccccgaggtggagccccggcacgccgccaccggcggcaggctgctcatggcgcgcgtgggccgaaccactgaggagctcaggcgcgacgtgctgcgcgaggacccggagcccacctggctgcctcccggctacggcgtggacacgcgcgtgctcaagcccgaccgccgctcgctgaagcgcttccgctacgacgtcaagacgctgggcaagaagcccggagacatggtactgtggatgcgggacaaggccgcgcagctgctgggcggcaagagccacgaggacaaggagaaggagaaggcggagctggatgcggcgcgcatgaagcgcgaggccgaggacaaggaccacatcggcccccgcttccgcccgcccgtcaacgccacagctatggacccgaaggagcaggccaaggccaagctgcggtcgggcctgacgccgcagcagatggtggcccaggagttcgcgctggtgtaccagccctacaacatcgccgccgtaaacatgatccaggacaccactggcctggagccgctggtggccgagtacctcaagattgagcaatccctggaggactacctggacatggccaagctgcgcctcaagctgcgcaaggcgctgcccatgaagattgtgcgcatcagccccaagctgcagggtgacgcctggccggccgtgcagagcgaaatgatccggatcgtgaagagccagtacgagtacatgcgggagcaggcgcacgcgcgctccaagcaggcactggagctccacgaccgtgaaatcaaccccaaggcaagcaggagctcgcggcgcgcggagaaggacgtgctgcagaagcgagcggtcgcattgggcgctgaggaggcgaacctgccgaggcaggaggcggaggcgctggcggcaatccagaagatcatgcccaagagatggagcgccaaggtggacgcggtgacctactggctggcccggctcaagtacctgcgggagtgcatcaagatccagcaggcggtcgccagccgcaagatcgcgccctccgccttcgtcaccttcaacacgcgcatggcccagggcgtggcctccaactcgctgcacgcgcacgacgagaccagctggcgcatcatgccggcgcccgcgcccatcgaggtggtgtggggcaacctgatgatgacgcaccccgtgcgcaccggccgcctgtggctgatctgggtggcgttctgggccatgacgctgttcttcatgattcccgtcacgctcatccaggcgctgattgaggtgcccaagctggcgtccatcccggtgctcggtgacatcgtgacggcgccggtggtgaagcagctgctggaggcgatcatcccgggtacgtgtcgtgtggtggtggtgttctttgggtccatcatcgccggctctttcttcaaccagatcacgcagtgggtcaaggaccctgcctccgtcatttccgtgctgggcaagtccattcccatgaccgccacattcttcatcacctacctcttcgtgaacggcctggcggtgcgctccatccagtttgtacgcctgtccgacttcgtggtcttctggatcctgtccaagttcgcgggctcgccgcgcgcgcgcgagcgcatgtggatgaaccaagtccagttctacggcaagaccgtgccggaccacaccatcgcaatgctcctgggcctggtcttctgctgcatgaaccccatcgtgtgcccggcggccctggcgtacttcctggtggcgtgcgtgggagagcgctacaacgtcatctacgtgtacaggccacagtacgagagcgctgggcggctgtggaagacggtctacaaccagatcatggttgcaatctacatcatgctgctcgccatgtttggcctgctggccatcaagaagttcgcggccacattcctgctggtgccgctcatcatcggcgtactgctgtcgcacctctccacgctcacgctctacagccgcccctggaccgtcacggcgctgcacgacgctgcggagatggacatgctggaggcggaccagcgccgtgagcacctgctggccatggcgcgagacgagcgcaagaaggctaagctggagcagaagcagcgctacgagaccgcctgcatcgcggcggagaaggaagacaagcccgccccgccagcgtccgacttcttcacggagatcaagccgggcaaggccgagcggctgctgtatgagacgctcgagggcgaaggcttttcgctcaacagcgcagagaagaaggagatcgccgacatggcggtgccgcccacctgccttgagggcggcgtaaggatgcacctggagcacctggaggaggtggagaagctggcgcgggtggtgcagagcctgctgccctcgctcaaccagttcgtgtccgagtacaagaactaccgccgcaccgtcaaggcccacaagatcaagggcgacaccgcgaccggcgccgaagtgccgcacatgcccgaggaccttacgatcttcgacaacgacccgcgcctggtgagcctggaccaggagatggcggatcggcccgacgacgccgcctcgctgtcggcggcggaggccagcgacgacgacgaggagcggctgggccgtgacgtggaggcggcgctgggcatggagctgcaggagaccaagagcgcggccgccagctccaagggcttcaagcaggtctgaggtgtccatgtggtggtggagggcggatgggaggaggt

SEQ ID NO: 509 - protein, 1429 aa, Chlamydomonas reinhardtii
MLGLFTLFTIVRVRPWAKRFFAPRRYARDVDLKPKRMSSFYLGWVKPIMLYKEEDIIDEVGLDAAMYLRVLWFGMELFFMLTLICIPLVLPTNMTSGEIERLLAQAEEAQSLVLNNSVVVQPRNTSLLGDDNHNDVRFMYMSQGTVVANNMAPWNTSITFNATMVENNVTFVQDFFSNYSCKDTAEPYLSFAAYNMTYVRISGTKRYNNDSLTVLLKDAIVFLGWQNMSVIPASLQAVNNSGFDYIIVWSLEGETEQTQLTVNGKEFKFTNFDKYSLSNIPAGSAKMWAHVVALWLVTLFTMWRLREYNLQSVYLRLLFLGNSKRGGPSHTVLVTDVPFVSDAVACGLRAEEYREKHGLPASVTSLKKSMSIKNPMYEGYESLEGGPDGRTAVGVPVSTSAGEPRLPGTKSVTIVEPGGKNGAGGAAQQPASSLRSSQAASLKQSQAGALKVHTTNGGGAYAAETPRANGGGSTAQSGDMRVSEFASATYEAESAAGGDKRSAAGDSGVGGKEGGAVVQAVGVPIEECLKYRLHDPEVEPRHAATGGRLLMARVGRTTEELRRDVLREDPEPTWLPPGYGVDTRVLKPDRRSLKRFRYDVKTLGKKPGDMVLWMRDKAAQLLGGKSHEDKEKEKAELDAARMKREAEDKDHIGPRFRPPVNATAMDPKEQAKAKLRSGLTPQQMVAQEFALVYQPYNIAAVNMIQDTTGLEPLVAEYLKIEQSLEDYLDMAKLRLKLRKALPMKIVRISPKLQGDAWPAVQSEMIRIVKSQYEYMREQAHARSKQALELHDREINPKASRSSRRAEKDVLQKRAVALGAEEANLPRQEAEALAAIQKIMPKRWSAKVDAVTYWLARLKYLRECIKIQQAVASRKIAPSAFVTFNTRMAQGVASNSLHAHDETSWRIMPAPAPIEVVWGNLMMTHPVRTGRLWLIWVAFWAMTLFFMIPVTLIQALIEVPKLASIPVLGDIVTAPVVKQLLEAIIPGTCRVVVVFFGSIIAGSFFNQITQWVKDPASVISVLGKSIPMTATFFITYLFVNGLAVRSIQFVRLSDFVVFWILSKFAGSPRARERMWMNQVQFYGKTVPDHTIAMLLGLVFCCMNPIVCPAALAYFLVACVGERYNVIYVYRPQYESAGRLWKTVYNQIMVAIYIMLLAMFGLLAIKKFAATFLLVPLIIGVLLSHLSTLTLYSRPWTVTALHDAAEMDMLEADQRREHLLAMARDERKKAKLEQKQRYETACIAAEKEDKPAPPASDFFTEIKPGKAERLLYETLEGEGFSLNSAEKKEIADMAVPPTCLEGGVRMHLEHLEEVEKLARVVQSLLPSLNQFVSEYKNYRRTVKAHKIKGDTATGAEVPHMPEDLTIFDNDPRLVSLDQEMADRPDDAASLSAAEASDDDEERLGRDVEAALGMELQETKSAAASSKGFKQV

SEQ ID NO: 510 - DNA, 2976 bp, Saccharomyces cerevisiae
atggctgacagttcttcgacttcggcgttcatttcaaccctgattatctacggtcttaccgccgtcgtgtttgtctggctctttttgctattgcggcccaagaatagaagagtatacgagccacggtctcttaaggacattcagactattccggaggaagagagaacggaaccagttcctgaaggctacttcgggtgggttgaatatctactctcgaaaccgcactcgtttctcatccagcacacaagcgtggacggctattttctgttaagatatatcggtatcgtgggttcactttcgtttgtgggctgtttgcttcttttaccgatattgcttcccgtgaacgctaccaacggtaacaaccttcaaggctttgaactgctatcattttcaaatgttaccaacaagaacaggttttacgcgcacgttttcctctcgtggatcttttttggcctgttcacctatgtcatctacaaggagctgtattactacgtcgtgtttagacatgctatgcagacaacaccactctatgacggactgctgtcttctaggacggttatcgtcacagaattgcacaagagcatcgctcaagagggggagatgcaaatgcgtttccccaaggcttccaatgtggccttcgcgtatgatctctcagacttgcaagaattgtgtaaagaaagagctaagaacgctgcgaagtacgaagctgcgttgaataaggttctaaacaagtgcgtgaaaatgacccgaaacaagacccaaaagcaacttgacaagttgtacaataacggtaccaagccaaaggacgatttagagacatacgtgccacataaaaagcgccctaaacatcgtttgggaaaattgccgctttgtctaggcggcaaaaaagttaatacgttgtcttattctagtaaaaggattggggaattgaacgaagagattcatgaaaaacaagccgattgggccagtaatgataggcaacctgcctgctttatccagttcgagactcaattggaagcgcaaagatgctaccaatctgtggaagcaatcttgggtaagaaaaattttggtaagcgtcttattggctactcgccagaagacgttaactggggcagcatgcgtctcagttcaaaggagagacactccaggagagctgtggcaaatacaatcatggtgttattgattatcttttgggctttccccgttgctgtggttggtatcatctccaacgtcaatttccttaccgataaagttcccttcttacgtttcatcaacaacatgcccaccttcctgatgggtgtcattactggtttgttgcctactattgcgttggtcgttttgatgtctctagtgccaccttttatcgtaatgttggggaaacttagtggttgcgtcactaggcaagaaacggatctatactcccaagcatggtattacgctttcgctgtgattcaaatctttttagttgtcaccgctacctcttctgcatcttccaccgttgactcgattattgacagaccaagatccgccatgacactattggcaaataacttgccaaaggcatccaacttttatatcatgtacttcatattgaaaggtttaactggccccacatggacgatcttgcaggcagttaacttgctgctaagtaaagtcctaggtagagtgttggattctaccccaaggcaaaaatggaaccgctacaatactttggccacgccgcgcatgggcattgtttacccaggcattgaaattctggtttgcatttatatctgttactcgattatcgcccctatactgctatttttcagtaccgtaatgttgacgctactttatgtggcgtatttgtacaatttaaactacgtgtttggcttctccttcgatttaaaggggcgcaattatccaagagcacttttccagatttttgttggaatttacttgagtgaagtatgtctgcttggactgtttatcatggcaaaaacctggggtcctttggtcctggaagtgttttggatcgtggtcactgccctagctcatatatatatgaagaggaaattcataccgctattcgacgcagttcctttaagcgccatcagacatgcaagaggtgagcccggctattcctatcctacatcggacttgggtctccaggaaatcaaggacattgcagatgaaatgaagggcaaatacgaacaagacaatacacacgggattttgacgcccgtgaccaaggatgatttgaaaaaggccaatctgataccagataacgatggcagctcagagaacggtactcctagtaacccctttgagtctggttctgaacgtgcctctctctctggatcgaacgcagagagtgactcgatcaagaaattaaatgatactgttatcaaaaaatcaagcactctctcctcctctaccaaggacaacaacgaatctacttttgttccagagggtgaaaagtttcgcaagtttcactacagcgatgttgaggcattgagaaataagcgcccttatgatgaggatgatcatagtaaacatggacctgaaggtgccgtgccagtaaacgctgacgcgggagttatttacagtgatccggcagctgtcatgaaagagcctcaggcatttcctccggatgttttggaaaccaatacttggacaagaagaattctacaattcttcaacccaagaaggtcgtatcctttcgacagtgtcaggatgagattcccacttgttttcaacaccagcatcgaatacgatgaagaatatttgagctctgcttataccgatccatgtgtcagagagaaagatcccattgtgtggtgctgtaaggatccgttaggagtttcaaaacagcaaattcaagaggctaggtctaatggcttagatgtaagagatgatttcacaaggtacgatgaaaaaggaaaagtcatattcacttacaaccctcctgattatgaacctgaggctaaaaaatga

SEQ ID NO: 511 - protein, 991 aa, Saccharomyces cerevisiae
MADSSSTSAFISTLIIYGLTAVVFVWLFLLLRPKNRRVYEPRSLKDIQTIPEEERTEPVPEGYFGWVEYLLSKPHSFLIQHTSVDGYFLLRYIGIVGSLSFVGCLLLLPILLPVNATNGNNLQGFELLSFSNVTNKNRFYAHVFLSWIFFGLFTYVIYKELYYYVVFRHAMQTTPLYDGLLSSRTVIVTELHKSIAQEGEMQMRFPKASNVAFAYDLSDLQELCKERAKNAAKYEAALNKVLNKCVKMTRNKTQKQLDKLYNNGTKPKDDLETYVPHKKRPKHRLGKLPLCLGGKKVNTLSYSSKRIGELNEEIHEKQADWASNDRQPACFIQFETQLEAQRCYQSVEAILGKKNFGKRLIGYSPEDVNWGSMRLSSKERHSRRAVANTIMVLLIIFWAFPVAVVGIISNVNFLTDKVPFLRFINNMPTFLMGVITGLLPTIALVVLMSLVPPFIVMLGKLSGCVTRQETDLYSQAWYYAFAVIQIFLVVTATSSASSTVDSIIDRPRSAMTLLANNLPKASNFYIMYFILKGLTGPTWTILQAVNLLLSKVLGRVLDSTPRQKWNRYNTLATPRMGIVYPGIEILVCIYICYSIIAPILLFFSTVMLTLLYVAYLYNLNYVFGFSFDLKGRNYPRALFQIFVGIYLSEVCLLGLFIMAKTWGPLVLEVFWIVVTALAHIYMKRKFIPLFDAVPLSAIRHARGEPGYSYPTSDLGLQEIKDIADEMKGKYEQDNTHGILTPVTKDDLKKANLIPDNDGSSENGTPSNPFESGSERASLSGSNAESDSIKKLNDTVIKKSSTLSSSTKDNNESTFVPEGEKFRKFHYSDVEALRNKRPYDEDDHSKHGPEGAVPVNADAGVIYSDPAAVMKEPQAFPPDVLETNTWTRRILQFFNPRRSYPFDSVRMRFPLVFNTSIEYDEEYLSSAYTDPCVREKDPIVWCCKDPLGVSKQQIQEARSNGLDVRDDFTRYDEKGKVIFTYNPPDYEPEAKK

SEQ ID NO: 512 - DNA, 2616 bp, Schizosaccharomyces pombe
atgtccgacagcagcagttcttctacgtcggcgttcgtatcatcgttagtcttcaattttgctatcttttgcgccttcatcggtctttttttatgtttgcgtcctcgcgagaaacacgtttaccaacctagatgtattatagatactcaaccaaaagaagagaaaccagagccttccccctctagcccttttggtttgtttgcttacgttgtgaaacgctctgagacatatcttatccaatacgctggtgtggatggttatttttttattcgctatctcttcacatttggtgccctttgtatcctaggctgtttagttcttttccccatcctccttcctgtaaacgcaacaaacggtgtgggtgaaaagggatttgatattctttcattctcaaacgtcaaaaatcataatcgattttatgcccatgtttttctctcttggttgtttttcggtttcaccattttcataatatatcgtgagcttcgctattatgttatttttcgacatgccatgcaatcttcaggtctttataacaatcttccttcttcctctacgatgttgctgactgagcttccaaactcagttttaaacgatgaggaaactcttcatgagctttttccaaacgcttctgagtttacatgcgtccgtgatctcaagaagctggaaaaaaaggtcaagaaacgcagtgaccttggaaacaagtatgagagtactcttaacagccttattaataagtctgttaaaaaacataataagcttgtcaaaaagcataagccacttccttcaaccttggattataccgcttacgtgaagaagcgtccaactcatcgccttaaattcttgattggaaaaaaggttgatactattgactactgtagagacacgatcgctgaattggatgaggttgtcgataaattacaaacttcactcgaggagcgcaaaaaagttggttctgtgtttatcagattccgtagtcaaacggacttgcaaactgcttatcaggccttcctttactcaaaaaagtttagaaaataccgtttcggtcgtgctttggtcggcattgctccagaagatatcgtttggtccaatcttgacctttctatgtacaccagaagaggcaaaaagactatttcaaatactattcttactcttatgattattttctgggcatttccagttgcagtagtcggttgtatatccaacgttaactatcttattgaaaaggttcatttcttgaaatttatcgaccatatgcctccaaaattgcttggtatcattacaggaattctcccctctgttgctctctccattttgatgtcgcttgttccaccgtttatcaagtttttaggaaagtttggcggcgctcttaccgttcaagagattgaaaattattgtcaaaactggtattacgcatttcaggtcgttcaagtctttttggtaactacaatgacatcggctgctacgtctgccgttgtacaagttattaaagaaccagcatcttccatgacactacttgccagtaatcttccaaaggcgtctaacttttacatttcatatttccttttgcaaggactttcaattcctggaggagctttattgcaaatagtaacattacttttgtcgaaagttttagggcgcatattcgataatacacctcgaaagaagtggaatcgctggaatcaactttccgcacctagctggggtacggtttatccggtctattctttgttggtgactatcatgatttgctactcgatcattgctcctattataattggatttgccgctgtagcatttgttttaatttattttgcatattcctataatttaatttatgtcttagggcataacgctgacgcaaagggcagaaattatcctagagctcttttccaagtatttgtcggtctttacttagcagaagtctgcttaattggcttatttgttttggctaagaattggggcgctaccgtactcgaagccgtatttttgggttttacggtggcatgccatctttatttcaaatacaaatttttacctttgatggatgctgttccaattagtgctatcgaaagtgtttccgagcgacctgaaattaaatatccaatggacctgggtacgtctgaaatgaagaacgtgggtcgtgcttatcccgaaattctggaaaaattgtcatcatcttctggaagtgatgaattcttagaaacaagtagcagaacttcggaaaataccaaagaaaaaatagataaggacgacgagggctttgctattacgaatatctcatctgtacataaaatgcctagtttcgttttaagttatttttctgaccttgctgcttctaataggatcctgactggattcgatcgtgttttacaattacttccttcattttacgatattcctgtgcgtgtacgtaatgtacaatatgtgagtcctgctttgaaagctacaccaccatcagtttggattccaaaagatcctcttggattgtcgacctatgcaattgaggatgcgcgtggaaaggtggatattttcgacgataacacaacatttaatgagaagggtaatctccaatatactggtccacctcccgactacgatgaggcgatcaggagttaa

SEQ ID NO: 513 - protein, 871 aa, Schizosaccharomyces pombe
MSDSSSSSTSAFVSSLVFNFAIFCAFIGLFLCLRPREKHVYQPRCIIDTQPKEEKPEPSPSSPFGLFAYVVKRSETYLIQYAGVDGYFFIRYLFTFGALCILGCLVLFPILLPVNATNGVGEKGFDILSFSNVKNHNRFYAHVFLSWLFFGFTIFIIYRELRYYVIFRHAMQSSGLYNNLPSSSTMLLTELPNSVLNDEETLHELFPNASEFTCVRDLKKLEKKVKKRSDLGNKYESTLNSLINKSVKKHNKLVKKHKPLPSTLDYTAYVKKRPTHRLKFLIGKKVDTIDYCRDTIAELDEVVDKLQTSLEERKKVGSVFIRFRSQTDLQTAYQAFLYSKKFRKYRFGRALVGIAPEDIVWSNLDLSMYTRRGKKTISNTILTLMIIFWAFPVAVVGCISNVNYLIEKVHFLKFIDHMPPKLLGIITGILPSVALSILMSLVPPFIKFLGKFGGALTVQEIENYCQNWYYAFQVVQVFLVTTMTSAATSAVVQVIKEPASSMTLLASNLPKASNFYISYFLLQGLSIPGGALLQIVTLLLSKVLGRIFDNTPRKKWNRWNQLSAPSWGTVYPVYSLLVTIMICYSIIAPIIIGFAAVAFVLIYFAYSYNLIYVLGHNADAKGRNYPRALFQVFVGLYLAEVCLIGLFVLAKNWGATVLEAVFLGFTVACHLYFKYKFLPLMDAVPISAIESVSERPEIKYPMDLGTSEMKNVGRAYPEILEKLSSSSGSDEFLETSSRTSENTKEKIDKDDEGFAITNISSVHKMPSFVLSYFSDLAASNRILTGFDRVLQLLPSFYDIPVRVRNVQYVSPALKATPPSVWIPKDPLGLSTYAIEDARGKVDIFDDNTTFNEKGNLQYTGPPPDYDEAIRS

SEQ ID NO: 514 - DNA, 2628 bp, Ashbya gossypii
atggcagacgctaacgacagttcagactcgaactcaacgtcctcctttgtttcggcgctgattttatatgggatcatcgggctagtttacacgctcatcttcctcgcgctgcgcaagcgctacagacgggtgtatgaaccacggaccctcgacgatgtgcgcacgctacagccttcggagcgggtggagtcggcaccggcggggtacgtctggtggctgccacacctgctctacaagccccacaagtcactgctgcagcacatgggcgtggacgcgtacttcttcgcacgctacttggccgtgtttgggacgctggcgttgatagggtgctttattcttttgccgatcctgttgcccgtgaacgcggcgggcggccgccacctccgcggcttcgagcgcatatccttcagcaacgtggccatgagccggcgcctgtacgcgcacgtgttcctgtcgtggatattctttgggctcgtgctctacgtgatctaccgcgagttgtactactatgtgtccatgcgccaggcgctgcagacctcgccctactactcgtcgctgctgcagtcccggacggtgctattcacggacgtgcgcggcggcactgacgcggaaagcgtgctgcggggcgccttcactggcgtggaggaggtcgtctacgcaaaggaccacacagagctccgcaaattagtgaaggagcgcaacaagactgcaaacaagtacgagtccgcccttaacaaggtggtgaacaagagcgtcaaggtgcgccgcaaggccgagctcaagggcaacactgtgttgcagcagcgggaagacctcaaggacgatgacttcgagcgctacgtgaaaaagaggcccacccacagacttggcaaaataccttgcgtcggagagaaggtagacaccctgaaacactgcgcaagccgcctggggtcgctcaactcgcgcgtgaagtccgagcaggaagagtgggagaccagccagcctctaaatacgtgctttgtgattttctctacgcagcgcgatgcccaggaggcttaccagcgggcgcccgtggccttgcccaagggctcctacgaccgctgtatcataggctgtgccccagacgatgtgaactgggacagcctttcaatgagcaagagcgtgcgcaggtcgaagcggctggtgggcaactctatcctgaccgcgatgatcatcttctgggccatcccggtcgccgtggtgggctgtatctccaacatcaacttcctaaccgagaaggtccacttcctgcggttcattaacaacctcccagacgtgctgatggggctcatcacgtcattgttgcccacgatcatgctcgcagtgctaatgtcgctcgtgcccatttttatccagctcgtggcgaacaagacaggctcgatcagccgccaggagacgcagctgtactgccagagatggttctacgcgttccaagtcgtgcacgtggtgctggtggtgatgctcgcgtcttccgcagcttcgacggttaccgccatcatcgacgacccgaacaacgccttcgagcagctcgcgcagaacatgccgctgtccgctaacttctacctctcctacgtgatgttgttcgccttcatctttgcttccggcgtgctgttgcagctcacgggtttcgtcctgagcttcatcctgggtcggatcctagactcgacgcccaggcagaagtggacgcgctacaacacgctcaacttgccgacgtggggcgtcatgtacccgctcatggagctgcaggtctgcatcatgctcgcgtacgcgattgtgacaccggtgttgctgatcatcagcacgctggccctgctgttcgcatacgtggcctacatgtacgtcttcaactacgtctacggactgaagcacgactacaagggcagaaactatgtcaacgcgctgttccaggtctttgtgggcctctacctggccgaggtgttcctgttcgcgctgttcatcatgggccgtgcctggggcccgctcgtccttaacgtgatcatgctggccttcaccgtgctcgtgcacctctatctccagcgccggttcctgccgctcgtcgacgccgtgcccctcagcctccttgacggcgccgccggcagcgtcggcaaggaccagggctgggccgaggtcgtccgcgcaggccgcgcgcgcccgctggacggcctcgtcgccctcaccaacaggctcaccggcgccgcgacgccggcccacccggcccccgtcaaccccgacgccgagaaggccgcgctatcccgctccgcgcccgccgccgcctcatccgcgttggcccgcgtcaagaacttcttccaccccagcgccgcctacaactacgacctcgccaagagcaggctgcccgacacctacgacaagccgctcgagtacgccgagggctacacccgctccgcctacaccgacccctgtatccgcgacaaggagcccgtcctgtgggtccccgaggaccccatgggcgtcgccgccaggcaggccgccatcgccgagcagcacggagttaaggtctccaccagccacaccggcttcgacgagaagggagctgccatttacactgacaacccccccgattacaccccctatgactacgttaatcactag

SEQ ID NO: 515 - protein, 875 aa, Ashbya gossypii
MADANDSSDSNSTSSFVSALILYGIIGLVYTLIFLALRKRYRRVYEPRTLDDVRTLQPSERVESAPAGYVWWLPHLLYKPHKSLLQHMGVDAYFFARYLAVFGTLALIGCFILLPILLPVNAAGGRHLRGFERISFSNVAMSRRLYAHVFLSWIFFGLVLYVIYRELYYYVSMRQALQTSPYYSSLLQSRTVLFTDVRGGTDAESVLRGAFTGVEEVVYAKDHTELRKLVKERNKTANKYESALNKVVNKSVKVRRKAELKGNTVLQQREDLKDDDFERYVKKRPTHRLGKIPCVGEKVDTLKHCASRLGSLNSRVKSEQEEWETSQPLNTCFVIFSTQRDAQEAYQRAPVALPKGSYDRCIIGCAPDDVNWDSLSMSKSVRRSKRLVGNSILTAMIIFWAIPVAVVGCISNINFLTEKVHFLRFINNLPDVLMGLITSLLPTIMLAVLMSLVPIFIQLVANKTGSISRQETQLYCQRWFYAFQVVHVVLVVMLASSAASTVTAIIDDPNNAFEQLAQNMPLSANFYLSYVMLFAFIFASGVLLQLTGFVLSFILGRILDSTPRQKWTRYNTLNLPTWGVMYPLMELQVCIMLAYAIVTPVLLIISTLALLFAYVAYMYVFNYVYGLKHDYKGRNYVNALFQVFVGLYLAEVFLFALFIMGRAWGPLVLNVIMLAFTVLVHLYLQRRFLPLVDAVPLSLLDGAAGSVGKDQGWAEVVRAGRARPLDGLVALTNRLTGAATPAHPAPVNPDAEKAALSRSAPAAASSALARVKNFFHPSAAYNYDLAKSRLPDTYDKPLEYAEGYTRSAYTDPCIRDKEPVLWVPEDPMGVAARQAAIAEQHGVKVSTSHTGFDEKGAAIYTDNPPDYTPYDYVNH

SEQ ID NO: 516 - DNA, 2904 bp, Kluyveromyces lactis
atgtctgacgcagagggtgcatcatcttcaacatcggcatttgtgacgactttgatcgtcaacggtgtgatcgcaactgtattcgtttggcttttcttaacgttacgtccaaaacaacaaagggtgtatcaaccccggtctttaacggacatcaaaacgataccagagtctgagcgaacagaagaagtcccgtcagggtattttgattgggtcccgtatttgctaacaaaaccacattcatacttgatccagcatgcaagtatcgatggatacttgttcttgcgttacatctccatttttggaggtatctcattaatcggttgctttatacttttcccaattttattgccggtcaatgctaccaatggttacaatctagaagggtttgaattgcttgctttttcgaacgttagcaacaagaatagattctttgcacatgtatttttgtcttggatcttctttggtctaatcatctttatcatctacagagaattatactattacgttacgcttcgtcattccattcagacttctccattgtacgatgggttactctcttctagaagtataattttgaccgacttgcagggcgatttttgctctgaaccggagttgaacgaaagatttttgaatgtatcacaagttttccttgctcgtgatttgagtaccttgcatgaattggttaaggagcgtgctcaactcgccaacaaatatgaatctacactaaacggagtcatcaccaaatcggttaagaagaaattaaaagctgataaaaagggtgaaaaggtagcagagggaaccactaatttggatcaacctcaaaatgatttggaaacttacattccactgaagaaaagaccaaagcacaggttatccaagattcctatattaaatatttgtttgagtgagaaggttgacacattggactactctgtgaaacatatcagtgagttgaatgaaaaaattggtacagagcaggaaagctgggaagataataacaccgtaggatcggcatttatcgaattcaagactcaatacgatgcgcaaagagcttatcaatcaatcccatatttgttcgataaagatatctacgacagcgctttaattggttacggaccagatgacgttatctgggaaagcacaagtatgaacaggaagacaagaaaagtcaagagattaggtggtaacacaattttaacattgatgatcatattttgggccattcctgttgctgtggttggttgtatctctaacatcaactttttgaccgacaaggtgccatttttaaggtttattgataacatgcctgatgttttgatgggtgttattactggtttattgccaactattcttttggcattattaatgtctttggttcctgtattcattaaaaaggttgctatgatgacaggagctttgacaaggcaagaaattgagctatattgtcacgcatggtattatgcattccaagtggttcaagtttttatagtcgttactttggcatcttcggcatccagtactgtcacagatatcatcgatgaacctgattctgctatgacgttgttggctcaaaatttgccaaaggcttctaacttctacatcgcctatttcttattgcaaggtttgactgtgccaagtggagctttgttgcaagttgttgcattgattttgagtaaagttcttggaagagtgcttgacaaaacacctaggcaaaaatgggctcgttataacacactttctcagcctagctggggtgtcgtttatccggtcttagaattgttggtatgtatcttcatcacttactctatcattgcaccaatcatcttggtattctctaccgttgcactaggtttcttcttccttgcctatttgtacaatttgacatatgtgatgagcttcagctatgatttacgtggtaggaactatccaagagcattattccaagtatttgttggattgtacttagctgaaatatgtctaattggtcttttcatcatggccaagacatggggtcctttggttttggaagcagtcttcttggctgctactgctcttgcccatatttacttcaagagaagatttattccattgtttgatgcagttccattgagcgcaatcagatacgctagaggtgaagaaggttcttattacccagccaaggatcaaggtttgaacgaaattcaagtcgaaggtaagaaacttgcagaaaacattctatctgaagatagaaatggggtcttccaagaaactacaaaacaagatttgcagagagttaacatgctgcctgatgagtatgaagattctcttgaaaatgattcaaagagcaataatggtaacggaactatttcgggcagctcgaaacagaatccaagcacctttgtcaacgattcagaacaattccataagacaaaagtacctccacaaattccaccaccagaagttcaccaggaagaaagagaccccaacatcattgtcaaccgcgcggatgctgggcaagttatctccgatgttaagggttacccaataaatgcaccagaagagcaactcggtttaccatccgatctgatcagaccaaagagtatcgtggcccgttgcaagctattcttccaacctcagaagtactacgatttcgctattgtaaggcaaactctaccttatgtcttcaatgacgtcattagatacgatttggagtacttggaaaccgccttcaccgagccttgtgttagagagaaggaaccaattatatggtgtgcaagagatcctatgggattgtcccatcagcaaatatccattgcatctgccagtggtgtggatgttagagatgatttcgctggttatgacgagacgggtaagacaacatactctaatagtcctccagactacgaaatgattgccaaaaagtga

SEQ ID NO: 517 - protein, 967 aa, Kluyveromyces lactis
MSDAEGASSSTSAFVTTLIVNGVIATVFVWLFLTLRPKQQRVYQPRSLTDIKTIPESERTEEVPSGYFDWVPYLLTKPHSYLIQHASIDGYLFLRYISIFGGISLIGCFILFPILLPVNATNGYNLEGFELLAFSNVSNKNRFFAHVFLSWIFFGLIIFIIYRELYYYVTLRHSIQTSPLYDGLLSSRSIILTDLQGDFCSEPELNERFLNVSQVFLARDLSTLHELVKERAQLANKYESTLNGVITKSVKKKLKADKKGEKVAEGTTNLDQPQNDLETYIPLKKRPKHRLSKIPILNICLSEKVDTLDYSVKHISELNEKIGTEQESWEDNNTVGSAFIEFKTQYDAQRAYQSIPYLFDKDIYDSALIGYGPDDVIWESTSMNRKTRKVKRLGGNTILTLMIIFWAIPVAVVGCISNINFLTDKVPFLRFIDNMPDVLMGVITGLLPTILLALLMSLVPVFIKKVAMMTGALTRQEIELYCHAWYYAFQVVQVFIVVTLASSASSTVTDIIDEPDSAMTLLAQNLPKASNFYIAYFLLQGLTVPSGALLQVVALILSKVLGRVLDKTPRQKWARYNTLSQPSWGVVYPVLELLVCIFITYSIIAPIILVFSTVALGFFFLAYLYNLTYVMSFSYDLRGRNYPRALFQVFVGLYLAEICLIGLFIMAKTWGPLVLEAVFLAATALAHIYFKRRFIPLFDAVPLSAIRYARGEEGSYYPAKDQGLNEIQVEGKKLAENILSEDRNGVFQETTKQDLQRVNMLPDEYEDSLENDSKSNNGNGTISGSSKQNPSTFVNDSEQFHKTKVPPQIPPPEVHQEERDPNIIVNRADAGQVISDVKGYPINAPEEQLGLPSDLIRPKSIVARCKLFFQPQKYYDFAIVRQTLPYVFNDVIRYDLEYLETAFTEPCVREKEPIIWCARDPMGLSHQQISIASASGVDVRDDFAGYDETGKTTYSNSPPDYEMIAKK

SEQ ID NO: 518 - protein, 124 aa, Artificial sequence
  DUF221 domain
LEAEQKTTLREKQQQAAIVFFNRRSAAASASQTLHAQMFDKWTVEQAPEPRQIIWSNPSKKIYERQIRQVVVYTIVFLTVVFYMIPITAISALTTLEKLREKLPFLKVVVDQPKIKTVLQAYLP

SEQ ID NO: 519 - protein, 414 aa, Artificial sequence
  DUF221 domain
ETDERGKIMKDPKSVVPAAFVSFRSRWGAAVCAQTQQTSNPTVWLTEWAPEPRDVYWDNLSIPFVYLTIRRLIIAVAFFFLNFFYVLPIAFVQSLANIEGIEKAAPFLKPLIEMRTIKSFIQGFLPGIALKIFLILLPSILMFMSKVEGLTSVSSLERRSAFKYYIFLFFNVFLGSIIAGSALEQLKTFLHQSANEIPRTIGEAIPMKATFFITYVMVDGWAGVAGEILRLKPLIIFHLKNFFLVKTEKDREEAMDPGSIGFDSNEPQIQLYFLLGLVYAVVTPFLLPFILIFFGLAYVVYRHQIINVYNQEYESAAAFWPSVHGRIIVALIVSQLLLLGLLSTKGAGQSTPVLLVLPVVTFYFYKYCKNRYEPAFVEYPLQDAMRKDTLERAREPGFDLKGYLMNAYIHPVFK

SEQ ID NO: 520 - protein, 399 aa, Artificial sequence
  DUF221 domain
SIRLLQCENMLKRKELPVAFVSFKSQLDAAQAAEMQQHVNPLSLVTTYAPEPPDALWTNLAIPFCRIAIYKLGVFIAAFLLIVFFTIPVTAVQGIVQFEKIKIWFPPARAVELIPGLNSVVTGYLPSMILNGFIYLIPFAMLGMASFEGCIAKSQKEIKACNMVFYFLLGNVFFLSILSGSLLHQIGESFTHPKDIPSRLARAVSAQSDFFITYILTDGMSGFSLEVLQFGLLTWHFFKAHSIGHSEQPYLYGFPYYRVVPIVSLAVLIGLVYAVVAPLLLPILVIYFLLGYAVYINQMEDVYEITYDTCGQYWPNIHRYIFLSVTLMQITMLKSKPGASFATVPLLVSTILFNEYCKVRFLPTFLHRPVQVAKENDDLNEAEGMRGDLDHAISAYKPP

SEQ ID NO: 521 - protein, 451 aa, Artificial sequence
  DUF221 domain
KKLVLGSRLSDYKDGRAPGAGIAFVVFKDVYTANKAVRDFRMERKKTPIGRFFPVMELQLERSRWTVERAPPASDIYWNHLGLSKTSLGLRRIAVNTCLILMLLFFSSPLAIISGMQSAARIINVEAMDNAKSWLVWLQSSSWFWTIIFQFLPNVLIFVSMYIIIPSVLSYFSKFECHLTVSGEQRAALLKMVCFFLVNLILLRALVESSLESWILSMGRCYLDSVDCKQIEQYLSPSFLSRSSLSSLAFLITCTFLGISFDLLAPIPWIKHVMKKFRKNDMVQLVPEENEDYQLMHDGEETNNLRAPLMSEREDSGILNGIEEHDLSLYPINRSFHMPKQTFDFAQYYAFDITIFALTMIYSLFAPLTVPVGAVYFGYRYLVDKYNFLFIYRVRGFPAGNDGKLMDMVICIMQFCVIFFLVAMLLFFAVQGDPMKLQAICTLSLLVFYKL

SEQ ID NO: 522 - protein, 408 aa, Artificial sequence
  DUF221 domain
KHDVKDSELSLPDKDCGAAFVFFKTRYAALVVSEIVQTSNPMEWVTSLAPDRDDVYWSNLWLPYKQLWIRRIVTLSGSIVFMFLFLIPVTFIQGLTQLEQLQQRLPFLNGILKKKYITQLVTGYLPSVILQIFLYTVPPTMMFFSTLEGPVSHSERKRSACCKVLYFTIWNVFFVNVLSGSAISQVNALSSPKDIPMVLARAVPVQATFFTTYVLTSGWASLSSELMQLFGLTWNFIMKYVLRMKEDSYFVPSFPYHTEVPKVLLFGLLGFTCSVLAPLILPFLLVYFFLGYVVYRNQFLNVYCTKYDTGGLYWPIAHYTTIFSIVLTQIICLGVFGLKESPVAAGFTVPLIILTLLFNQYCSNRLRPLFKTLPAQDLIDMDREDEQSGRMDDIHHRLHSAYCQFADT

SEQ ID NO: 523 - protein, 408 aa, Artificial sequence
  DUF221 domain
KPDLSDPEVIEAQKDCPGAIVFFKTRYAAIVASRILQSSNPMLWVTDFAPEPRDVYWSNLWIPYRQIWLRKIATLAASVAFMFVFIVPVAFVQSMMQLDQIEQLFPSLKNMLKKPFFVKLVTGYLPSVVLLLSLYTVPPLMMFFSSIEGSISRSGRKKSACCKILFFTIWNVFFVNVLSGSVLNQLNVFTRPRDMPSMLAELVPKQATFFITYVLTSGWASLCSEILQVYNLVYNFFRKCIFCYRDDPEYGYSFPYHTEVPKVLLFNLLGFTFSIMAPLILPFLLVYFCLGYLVYRNQILNVYYPKYEMGGKLWPIMHSTLVFALVLTQTIALGVFTIKHATISSGFTVLLIIGTVLFHQYCRHRFSSIFNSFSAQDLIEMDRDDEQSGRMEEIHKHLLDAYSQGTTN

SEQ ID NO: 524 - protein, 414 aa, Artificial sequence
  DUF221 domain
EDEERHKVITDPNAIMPAAFVSFKSRWGAAVCAQTQQTSNPTLWLTEWAPEPRDVFWPNLAIPFVELSVRRLIMAVALFFLTFFFMIPIAIVQSMANLDDIERMLPFLKPIIERNSLKSIVQGFLPGIALKIFLILLPTFLVMMSKIEGHTSLSGLDRRTASKYYLFLFVNVFLGSVITGTAFQQLNNFIHQSANKIPEIVGESIPMKATFFITYVMVDGWAGVAAEVLRLKPLVMFHIKNTFLVRTERDREQAMDPGSLDFGTTEPRIQLYFLLGLVYAVVTPILLPFIIVFFSLAYLVFRHQIINVYNQQYESGAQFWPDVQRRLVIALIVSQILLLGLLSTQEAEKSTVALLPLPVLSIWFHYVCKGRFEPAFIKFPLQDAMVKDTLERANDPTLNLREYLKDAYVHPVFQ

SEQ ID NO: 525 - protein, 414 aa, Artificial sequence
  DUF221 domain
EADERQKIMKDPQSAVPAAFVSFRSRWGAAVCAQTQQTSNPTVWITEWAPEPRDVYWNNLSIPFVSLTVRRLIVAVAFFFLNFFYVIPIAFVQSLASLEGIEKALPFLKPLIKIDVIKSFIQGFLPGIALKVFLILLPTILMFMSKFEGLISQSSLERRSASKYYIFLFFNVFLGSIVTGSALDQLKAYIHQSANEIPRTIGVAIPMRATFFITYVMVDGWTGVAGEILRLRALIIFHLKNFFLVKTEKDREEAMDPGSICFDWCEPRIQLYFLLGLVYAVVTPLLLPFILVFFGLAYVVYRHQIINVYNQQYESGAQFWPSVHGRIIIALIVSQLLLIGLLSTKGFEETTPVLVVLPVLTFWFYKYCKNRFEPAFVRNPLQEAMRKDTLERAREPTFDLKAYLANAYLHPVFK

SEQ ID NO: 526 - protein, 411 aa, Artificial sequence
  DUF221 domain
LEAEQKTTLREKQQQAAIVFFNRRSAAASASQTLHAQMFDKWTVEQAPEPRQIIWSNLSKKIYERQIRQVVVYTIVFLTVVFYMIPITAISALTTLEKLREKLPFLKVVVDQPKIKTVLQAYLPQLALIVFLALLPSLLMFLSKLEGIPSQGHTVRAAAGKYFYFIVFNVFLGVTISSTLFSALTTIINNPPGIVNMLASSLPGSATFFLTFVALKFFVGYGLELSRLVPLIIFHLKRKYLCKTEDEVRAAWAPGDLGYNTRVPNDMLIVTIVLCYSVIAPLIIPFGVAYFALGWIIVKNQVLRVYVPSYESNGRMWPHMHTRIIAALLIYQITMVGVILLKKFLYSPVLVPLIPISFIFAYICHMRFYPAFAKTPLEVVQHNVKDTPNMDAVYTSYIPACLKPEKLEDVD

SEQ ID NO: 527 - protein, 414 aa, Artificial sequence
  DUF221 domain
LASERQRVLNDPKAVMPVAFVTFDSRWGAAVCAQTQQSKNPTQWLTDWAPEPRDVYWQNLAIPFFSLSIRKFLISIAVFALVFFYMIPIAFVQSLANLEGIEKVAPFLRPVIDTPVVKSFLQGFLPGLALKIFLYILPTVLMIMSKVEGYVSLSSLERRAASKYYYFMLVNVFLGSIIAGTAFEQLNAFFHQPPSQIPRTIGVAIPMKATFFMTYIMVDGWAGIANEILRVKPLVIYHLKNMFIVKTERDRERAMDPGSIGLAENLPSLQLYFLLGLVYAVVTPILLPFIIIFFAFAFLVYRHQIINVYNQEYESAAAFWPQVHSRIIASLLISHVTLFGLMSTMKAAYSTPLLIFLPLLTIWFHKYCKSRFEPAFRKYPLEEAMEKDNLERTSEPNLNLKSYLQNAYLHPIFH

SEQ ID NO: 528 - protein, 407 aa, Artificial sequence
  DUF221 domain
NVRMEQSDTTRSRQEVPAAFVSFRSRYGAANAIYIRQSDKPTEWQTEHAPDPHDVYWPFFSTSFMDRWISKFVVSVASILLILVFLLVSAFVQGLTYMEQLETWLPFLRNILEIAVVSQLVTGYLPSVILHFLSSYVPSIMKLFSTMQGFISVSGIERSACNKMLRFTIWSVFFANVLTGSVLGQLEIFLDPKEIPKRLAVVVPAQASFFITYVVTSWTSIASELTQTAALLFHLWGSCAKCCKRDESKPPSMHYHSEIPRVLLFGLLGLTYFIVSPLILPFVLVYFCLGYFIYRNQLFNVYSPKYDTGGRFWPIVHGGTIFSLVLMHVIAIGVFGLKKLPLASSLLVPLPVLTLLFNEYCRNRFLPIFEAYSTESLIKKDREEESKPEMAEFFSNLVNAYCDPAMK

SEQ ID NO: 529 - protein, 408 aa, Artificial sequence
  DUF221 domain
KSDLQDSSLKLDDQECAAAFVYFRTRYAALVASEILQTSNPMKWVTDLAPEPDDVYWSNLWLPYKQLWIRRIATLLGSIVFMLFFLIPVTFIQGLSQLEQLQQRLPFLKGILEKKYMSQLVTGYLPSVILQIFLYAVAPIMILFSTLEGPISHSERKRSACCKVLYFTVWNIFFGNVLSGTVISQLNVLSSPKDIPVQLARAIPVQATFFITYVLTSGWASLSSELMQLFGLIWNFVRKYILRMPEDTEFVPSFPYHTEVPKVLLFGLLGFTCSVLAPLILPFLLVYFFLGYIVYRNQLLNVYRTRYDTGGLYWPIAHNAVIFSLVLTQIICLGVFGLKESPVAAGFTIPLIILTLLFNQYCRNRLLPLFRTTPAQDLIDMDREDERSGRMDEIHHRLHSAYCQFHDT

SEQ ID NO: 530 - protein, 406 aa, Artificial sequence
  DUF221 domain
ELGELTLTTTEEERPVAFVFFKSRYDALVVSEVLQTPNPMLWVADLAPEPHDVHWRNLRIPYRQLWMRRIATLVGAIAFMFVFLFPVTFVQGLTQLPTLSKNFPFLKDLLNRRFMEQVITGYLPSVILVLFFYTVPPLMMYFSTLEGCVSRSQRKKSACLKILYFTIWNVFFVNILSGSVIRQFTVLNSVRDVPAQLAKLVPAQAGFFMTYCFTSGWAGLACEIMQPVGLIWNLIAKVIVKNKEESYETLRFPYHTEIPRLLLFGLLGFTNSVIAPLILPFLLIYFFFAYLIYKNQIINVYITKYESGGQYWPVFHNTTIFSLILSQVIALGFFGLKLSTVASGFTIPLILLTLLFSEYCRQRFAPIFQKYPAEILIAMDRADEMTGKMEEIHNNLKVAYSQIPTC

SEQ ID NO: 531 - protein, 72 aa, Artificial sequence
  DUF221 domain
IMEERKKVKKDDTSVMPAAFVSFKTRWGAAVSAQTQQSSDPTEWLTEWAPEAREVFWSNLAIPYVSLTHRRH

SEQ ID NO: 532 - protein, 413 aa, Artificial sequence
  DUF221 domain
LETEQKAVLAEKQQTAAVVFFTTRVAAASAAQSLHCQMVDKWTVTEAPEPRQLLWQNLNIKLFSRIIRQYFIYFFVAVTILFYMIPIAFVSAITTLKNLQRIIPFIKPVVEITAIRTVLESFLPQIALIVFLAMLPKLLLFLSKAEGIPSQSHAIRAASGKYFYFSVFNVFIGVTLAGTLFNTVKDIAKNPKLDMIINLLATSLPKSATFFLTYVALKFFIGYGLELSRIIPLIIFHLKKKYLCKTEAEVKEAWYPGDLSYATRVPGDMLILTITFCYSVIAPLILIFGITYFGLGWLVLRNQALKVYVPSYESYGRMWPHIHQRILAALFLFQVVMFGYLGAKTFFYTALVIPLIITSLIFGYVCRQKFYGGFEHTALEVACRELKQSPDLEEIFRAYIPHSLSSHKPEEHE

SEQ ID NO: 533 - protein, 408 aa, Artificial sequence
  DUF221 domain
ELGELTMTTTTTEQERSAAFVFFKTRYDALVVSEVLQSSNPMLWVTDLAPEPHDVYWKNLNIPYRQLWIRKIATLVGAVAFMFVFLIPVTFIQGLTQLVQLSHAFPFLRGILSKNFINQVITGYLPSVILILFFYAVPPLMMYFSALEGCISRSIRKKSACIKVLYFTIWNVFFVNILSGSVIRQLNVFSSVRDIPAQLARAVPTQAGFFMTYCFTSGWASLACEIMQPMALIWNLVAKVVTKNEDESYETLRFPYHTEIPRLLLFGLLGFTNSVIAPLILPFLLIYFFLAYLIYKNQILNVYITKYESGGQYWPIFHNTTIFSLILTQIIALGFFGLKLSTVASGFTIPLILLTLLFSEYCRQRFAPIFNKNPAQVLIDMDRADEISGKMEELHKKLHNVYSQIPLH

SEQ ID NO: 534 - protein, 407 aa, Artificial sequence
  DUF221 domain
IMEERKRIKKDDKSVMQAAFVSFKTRWGAAVCAQTQQTKNPTEWLTEWAPEAREMYWPNLAMPYVSLTVRRFVMHIAFFFLTFFFIIPIAFVQSLASIEGIEKSAPFLSPIVKNKLMKSLIQGFLPGIVLKLFLIFLPTILMIMSKFEGFISISSLERRAAFRYYIFNLVNVFLGSVITGSAFEQLDSFLKQSANDIPRTVGVAIPIKATFFITYIMVDGWAGVAGEIFRLKPLVIFHLKNFFFVKTEKDREEAMDPGQIDFYATEPRIQLYFLLGLVYAPVTPVLLPFIIFFFGFAYLVFRHQKYESAGAFWPDVHGRIISALIISQILLLGLMSTKGKVQSTPFLLVLAILTFGFHRFCKGRYESAFVINPLQEAMIKDTLERAREPNLNLKGFLQNAYVHPVFK

SEQ ID NO: 535 - protein, 408 aa, Artificial sequence
  DUF221 domain
NIRLGQAEVSAPGKEVRAAFVSFKSRYGAATALHMPQSINPTYWLTEPAPEPHDVHWPFFSASFMQKWLAKILVVFACLLLTILFLVPVVLVQGLTNLPALEFMFPFLSLILSMKVVSQIITGYLPSLILQTSLKVVPPTMEFLSSIQGHICHSDIQKSACNKVIWFTIWNVFFATVFSGSAFYKLSVILDPKQIPLKLAVAVPAQASFFIAYVVTTGWTDTLTELFRVVPFMVSYIKRSFEPSDENEFVVPPMRYHRDTPRVLFFGLLGITYFFLAPLILPFILLYFILAYIIYRNQFMNVYAPKFDTGGMFWPMIHYTMIFSLVLMQAIAIGLFALKKMELATYLLVPLPVFTLLFNEFCRKRFMPIFTDYPAEVLTKRDKEDRNDPTMPEFYNNLVSAYKDPALL

SEQ ID NO: 536 - protein, 309 aa, Artificial sequence
  DUF221 domain
DMRLKQSLLAGEEVPAAFVSFRTRHGAAIATNIQQGIDPTQWLTEAAPEPEDVHWPFFTASFVRRWISNVVVLVAFVALLILYIVPVVLVQGLANLHQLETWFPFLKGILNMKIVSQVITGYLPSLIFQLFLLIVPPIMLLLSSMQGFISHSQIEKSACIKLLIFTVWNSFFANVLSGSALYRVNVFLEPKTIPRVLAAAVPAQASFFVSYVVTSGWTGLSSEILRLVPLLWSFITKLFGKEDDKEFEVPSTPFCQEIPRILFFGLLGITYFFLSPLILPFLLVYYCLGYIIYRNQVTEPISLLSIILC

SEQ ID NO: 537 - protein, 414 aa, Artificial sequence
  DUF221 domain
ISEEKETVMSSTKSLVPAAFVSFKKRWGAVVCSQTQQSRNPTEWLTEWAPEPRDIYWDNLALPYVQLTIRRLVIAVAFFFLTFFFMIPIAFVQTLANIEGIEKAVPFLKPLIEVKTVKSFIQGFLPGIALKIFLIVLPSILMLMSKFEGFISKSSLERRCASRYYMFQFINVFLCSIIAGTALQQLDSFLNQSATEIPKTIGVSIPMKATFFITYIMVDGWAGVAGEILRLKPLIIYHLKNFFLVKTEKDREEAMDPGTIGFNTGEPQIQLYFILGLVYAAVSPILLPFILVFFALAYVVYRHQIINVYNQEYESAAAFWPDVHRRVVIALIVSQLLLMGLLSTKKAARSTPLLFILPVLTIGFHKFCQGRYQPIFVTYPLQDAMVKDTLERMREPNLNLKTFLQNAYAHPVFK

SEQ ID NO: 538 - protein, 410 aa, Artificial sequence
  DUF221 domain
MIYHLQSETMLREKELPVAFVTFKSRRNAALAAQTQQHSNPLELITEMAPEPRDVSWRNLAIPQKILPLNKIGVILAAALLTIFFAIPVTAVQGIAKYEKLKKWFPPAMAIEFIPGLSSVVTGYLPSAILKGFMYIIPFAMLGLAYLGGSISNSKEEIKACNMVFYFLMGNVFFLSLISGSLLDEIGEYLTHPRDIPSHLAAAVSAQAEFFMTYILTDGLSGFSLEILQLGLILFDIIRSYTYGRGKERTPYLFSFPYFRVIPTVSLSIMIGMIYAVVAPLMLPFLVGYFCLGYIVYFNQMEDVYETTYDTCGRFWPFIHHYIFVSIILMQITMVGLFGLKSKPSAAIATVPLILITIAYNEYCKIRFLPSFKHFPIQTAVEIDEEDEKNGEMETHYVDAATAYNRHQPC

SEQ ID NO: 539 - protein, 414 aa, Artificial sequence
  DUF221 domain
MSLERQKVLKDSKLMLPVAFVSFDSRWGAAVCAQTQQSKNPTLWLTSSAPEPRDIYWQNLAIPFISLTIRKLVIGVSVFALVFFYMIPIAFVQSLANLEGLDRVAPFLRPVTRLDFIKSFLQGFLPGLALKIFLWILPTVLLIMSKIEGYIALSTLERRAAAKYYYFMLVNVFLGSIIAGTAFEQLHSFLHQSPSQIPRTIGVSIPMKATFFITYIMVDGWAGIAGEILRLKPLVIFHLKNMFIVKTEEDRVRAMDPGFVDFKETIPSLQLYFLLGIVYTAVTPILLPFILIFFAFAYLVYRHQIINVYNQQYESCGAFWPHVHGRIIASLLISQLLLMGLLASKKAADSTPLLIILPILTLSFHKYCKHRFEPAFRQYPLEEAMAKDKLEKETEPELNMKADLADAYLHPIFH

SEQ ID NO: 540 - protein, 414 aa, Artificial sequence
  DUF221 domain
IAEERENVVNDQKSVMPASFVSFKTRWAAAVCAQTTQTRNPTEWLTEWAAEPRDIYWPNLAIPYVSLTVRRLVMNVAFFFLTFFFIIPIAFVQSLATIEGIEKVAPFLKVIIEKDFIKSLIQGLLAGIALKLFLIFLPAILMTMSKFEGFTSVSFLERRSASRYYIFNLVNVFLGSVIAGAAFEQLNSFLNQSPNQIPKTIGMAIPMKATFFITYIMVDGWAGVAGEILMLKPLIIYHLKNAFLVKTEKDREEAMNPGSIGFNTGEPQIQLYFLLGLVYAPVTPMLLPFILVFFALAYVVYRHQIINVYNQEYESAAAFWPDVHGRVITALIISQLLLMGLLGTKHAASAAPFLIALPVITIGFHRFCKGRFEPAFVRYPLQEAMMKDTLERAREPNLNLKGYLQDAYIHPVFK

SEQ ID NO: 541 - protein, 415 aa, Artificial sequence
  DUF221 domain
ISEEKQRLRTGTKSIVPAAFVSFKSRWGAAVCAQTQQTRNPTEWLTEWAAEPRDIYYDNLALPYVDLKIRRLIVGVAYFFLTFFFMIPIAFVQSLANIEGIEKAFPFLKPLIEVKLLKSIIQGFLPGIALKIFLLFLPRILMQMSKFEGFVSTSSLERRAATRFYMFQFINVFLGSIVTGTAFQQLNSFLNQSANDIPKTIGVSIPMKATFFITYIMVDGWAGVAGEILRLKPLIIYHLKNSFLVRTEKDREEATDPGTIGFNTGEPQIQLYFLLGLVYAAVSPILLPFILVFFGLAFVVYRHQVINVYNQKYESAGKFWPDVHRRVVTALVVSQLLLMGLLSTKHASKSTPLLLVLPLLTIGFHKHCKNRYQPAFVTYPLQQEAMIKDTLDRIREPNLNLKAFLRDAYAHPEFR

SEQ ID NO: 542 - protein, 414 aa, Artificial sequence
  DUF221 domain
ISKEREEVVNDPKAIMPAAFVSFKTRWAAAVCAQTQQTRNPTQWLTEWAPEPRDVFWSNLAIPYVSLTVRRLIMHVAFFFLTFFFIVPIAFVQSLATIEGIVKAAPFLKFIVDDKFMKSVIQGFLPGIALKLFLAFLPSILMIMSKFEGFTSISSLERRAAFRYYIFNLVNVFLASVIAGAAFEQLNSFLNQSANQIPKTIGVAIPMKATFFITYIMVDGWAGVAGEILMLKPLIMFHLKNAFLVKTDKDREEAMDPGSIGFNTGEPRIQLYFLLGLVYAPVTPMLLPFILVFFALAYIVYRHQIINVYNQEYESAAAFWPDVHGRVIAALVISQLLLMGLLGTKHAALAAPFLIALPVLTIGFHHFCKGRYEPAFIRYPLQEAMMKDTLETAREPNLNLKGYLQNAYVHPVFK

SEQ ID NO: 543 - protein, 452 aa, Artificial sequence
  DUF221 domain
LRADLESQLAAYKEGRAQGAGVAFVMFKDVYTANKAVQDFRNERSRRTGKFFSVTELRLQRNQWKVDRAPLATDIYWNHLGLTKVALIVRRVIVNTILLLILVFFSSPLALISALVSAGRIFNAEALDSAQYWLTWVQTSGWIGSLIFQFLPNVFIFVSMYIVIPSALSYLSKFERHLTVSGEQRAALLKMVCFFLVNLIILKALVESSLESALLKMSRCYLDGEDCKRIEEYMSPSFLSRSCVSALAFLITSTFLGISFDLLAPIPWIKKKIQKFRKNDMLQLVPEQNEEYALENQEPSSNLETPLLPENMFESPRFGDIEPMSQDLSEYPISRTSPIPKQKFDFAQYYAFNLTIFALTMIYSSFAPLVVPVGAVYFGYRYIVDKYNFLYVYRVRGFPAGNEGKLMDTVLCIMRFCVDLYLVSMLLFFSVKGDSTKLQAIFTLGVLVMYKL

SEQ ID NO: 544 - protein, 454 aa, Artificial sequence
  DUF221 domain - consensus sequence
  UNSURE (2)..(3): Xaa can be any naturally occurring amino acid
  UNSURE (6)..(7): Xaa can be any naturally occurring amino acid
  UNSURE (10)..(10): Xaa can be any naturally occurring amino acid
  UNSURE (12)..(19): Xaa can be any naturally occurring amino acid
  UNSURE (43)..(43): Xaa can be any naturally occurring amino acid
  UNSURE (46)..(62): Xaa can be any naturally occurring amino acid
  UNSURE (64)..(64): Xaa can be any naturally occurring amino acid
  UNSURE (69)..(69): Xaa can be any naturally occurring amino acid
  UNSURE (79)..(79): Xaa can be any naturally occurring amino acid
  UNSURE (87)..(87): Xaa can be any naturally occurring amino acid
  UNSURE (89)..(89): Xaa can be any naturally occurring amino acid
  UNSURE (96)..(96): Xaa can be any naturally occurring amino acid
  UNSURE (99)..(99): Xaa can be any naturally occurring amino acid
  UNSURE (101)..(101): Xaa can be any naturally occurring amino acid
  UNSURE (118)..(123): Xaa can be any naturally occurring amino acid
  UNSURE (127)..(127): Xaa can be any naturally occurring amino acid
  UNSURE (131)..(132): Xaa can be any naturally occurring amino acid
  UNSURE (137)..(137): Xaa can be any naturally occurring amino acid
  UNSURE (140)..(143): Xaa can be any naturally occurring amino acid
  UNSURE (149)..(149): Xaa can be any naturally occurring amino acid
  UNSURE (154)..(155): Xaa can be any naturally occurring amino acid
  UNSURE (159)..(159): Xaa can be any naturally occurring amino acid
  UNSURE (163)..(163): Xaa can be any naturally occurring amino acid
  UNSURE (167)..(167): Xaa can be any naturally occurring amino acid
  UNSURE (171)..(171): Xaa can be any naturally occurring amino acid
  UNSURE (178)..(178): Xaa can be any naturally occurring amino acid
  UNSURE (181)..(181): Xaa can be any naturally occurring amino acid
  UNSURE (183)..(183): Xaa can be any naturally occurring amino acid
  UNSURE (187)..(187): Xaa can be any naturally occurring amino acid
  UNSURE (189)..(190): Xaa can be any naturally occurring amino acid
  UNSURE (192)..(192): Xaa can be any naturally occurring amino acid
  UNSURE (194)..(194): Xaa can be any naturally occurring amino acid
  UNSURE (196)..(196): Xaa can be any naturally occurring amino acid
  UNSURE (198)..(198): Xaa can be any naturally occurring amino acid
  UNSURE (212)..(212): Xaa can be any naturally occurring amino acid
  UNSURE (215)..(216): Xaa can be any naturally occurring amino acid
  UNSURE (219)..(225): Xaa can be any naturally occurring amino acid
  UNSURE (227)..(229): Xaa can be any naturally occurring amino acid
  UNSURE (233)..(234): Xaa can be any naturally occurring amino acid
  UNSURE (237)..(237): Xaa can be any naturally occurring amino acid
  UNSURE (241)..(243): Xaa can be any naturally occurring amino acid
  UNSURE (253)..(254): Xaa can be any naturally occurring amino acid
  UNSURE (261)..(261): Xaa can be any naturally occurring amino acid
  UNSURE (265)..(265): Xaa can be any naturally occurring amino acid
  UNSURE (267)..(267): Xaa can be any naturally occurring amino acid
  UNSURE (272)..(272): Xaa can be any naturally occurring amino acid
  UNSURE (276)..(277): Xaa can be any naturally occurring amino acid
  UNSURE (280)..(280): Xaa can be any naturally occurring amino acid
  UNSURE (284)..(288): Xaa can be any naturally occurring amino acid
  UNSURE (290)..(290): Xaa can be any naturally occurring amino acid
  UNSURE (293)..(293): Xaa can be any naturally occurring amino acid
  UNSURE (296)..(296): Xaa can be any naturally occurring amino acid
  UNSURE (298)..(298): Xaa can be any naturally occurring amino acid
  UNSURE (300)..(300): Xaa can be any naturally occurring amino acid
  UNSURE (303)..(303): Xaa can be any naturally occurring amino acid
  UNSURE (305)..(305): Xaa can be any naturally occurring amino acid
  UNSURE (308)..(308): Xaa can be any naturally occurring amino acid
  UNSURE (313)..(313): Xaa can be any naturally occurring amino acid
  UNSURE (330)..(330): Xaa can be any naturally occurring amino acid
  UNSURE (338)..(338): Xaa can be any naturally occurring amino acid
  UNSURE (344)..(347): Xaa can be any naturally occurring amino acid
  UNSURE (349)..(351): Xaa can be any naturally occurring amino acid
  UNSURE (357)..(357): Xaa can be any naturally occurring amino acid
  UNSURE (361)..(361): Xaa can be any naturally occurring amino acid
  UNSURE (364)..(365): Xaa can be any naturally occurring amino acid
  UNSURE (368)..(368): Xaa can be any naturally occurring amino acid
  UNSURE (381)..(383): Xaa can be any naturally occurring amino acid
  UNSURE (385)..(385): Xaa can be any naturally occurring amino acid
  UNSURE (387)..(388): Xaa can be any naturally occurring amino acid
  UNSURE (391)..(392): Xaa can be any naturally occurring amino acid
  UNSURE (395)..(395): Xaa can be any naturally occurring amino acid
  UNSURE (397)..(397): Xaa can be any naturally occurring amino acid
  UNSURE (402)..(402): Xaa can be any naturally occurring amino acid
  UNSURE (404)..(405): Xaa can be any naturally occurring amino acid
  UNSURE (409)..(409): Xaa can be any naturally occurring amino acid
  UNSURE (412)..(412): Xaa can be any naturally occurring amino acid
  UNSURE (414)..(414): Xaa can be any naturally occurring amino acid
  UNSURE (416)..(417): Xaa can be any naturally occurring amino acid
  UNSURE (422)..(422): Xaa can be any naturally occurring amino acid
  UNSURE (424)..(424): Xaa can be any naturally occurring amino acid
  UNSURE (426)..(427): Xaa can be any naturally occurring amino acid
  UNSURE (429)..(430): Xaa can be any naturally occurring amino acid
  UNSURE (432)..(437): Xaa can be any naturally occurring amino acid
  UNSURE (432)..(439): Xaa can be any naturally occurring amino acid
  UNSURE (441)..(443): Xaa can be any naturally occurring amino acid
  UNSURE (445)..(446): Xaa can be any naturally occurring amino acid
  UNSURE (449)..(454): Xaa can be any naturally occurring amino acid
IXXERXXVLXDXXXXXXXXVPAAFVSFKSRWGAAVAAQTQQTXNPXXXXXXXXXXXXXXXXXTXWLTEXAPEPRDVYWXNLAIPYVXLXIRRLVVXVAXFXLMFFFMIPIAFVQSLAXXXXXXNLEXLEKXXPFLKXILXXXXIKSVIXGFLPXXIILXIFLXILPXILMXMSKLEGXISXSXLERXAXXKXYXFXLXNVFLGSVLSGSALXQLXXFLXXXXXXXSXXXDIPXXLAXAIPXXXATFFITYVMXXGWAGVAXEILXLXPLIIXHLKXXFLXKTEXXXXXAXDPXSIXYXTXIPXIXLYXLLGLXYAVVAPLLLPFILVYFXLAYLVYRXQIINVXXXXYXXXYESGGXFWPXVHXXIIXALILSQILLLGLXXXKXAXXATXXLIXLXVLTIXFXXYCKXRFXPXFXXYPLQXEXMXXDXXEXXXXXXXXLXXXLXXAYXXXXXX

SEQ ID NO: 545 - protein, 9 aa, Artificial sequence
  motif 9
  VARIANT (3)..(3): Xaa is Asp, Arg or Glu
  VARIANT (5)..(5): Xaa is His, Glu, Asn or Arg
  VARIANT (6)..(6): Xaa is Asp, Ala or Gln
  VARIANT (7)..(7): Xaa is Val, Ala or Ile
  UNSURE (8)..(8): Xaa can be any naturally occurring amino acid
APXPXXXXW

SEQ ID NO: 546 - DNA, 51 bp, Artificial sequence
  primer 1
ggggacaagtttgtacaaaaaagcaggcttaaacaatggacaccgcgtcgt

SEQ ID NO: 547 - DNA, 50 bp, Artificial sequence
  primer 2
ggggaccactttgtacaagaaagctgggtcagcacttgcattagatggat

SEQ ID NO: 548 - DNA, 2194 bp, Oryza sativa; identical to SEQ ID NO: 117

SEQ ID NO: 549 - DNA, 3533 bp, Artificial sequence
  expression cassette comprising the GOS2 promoter, the nucleic acid encoding the YTP polypeptide and the T-zein + T-rubisco transcription terminator sequence
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttcatttaaatcaactagggatatcacaagtttgtacaaaaaagcaggcttaaacaatggacaccgcgtcgttcgtgacgtcgctgctgacgtcgttcgtgatcttcgtcgtgctggtgctggtgttcacgtggctgtcgagcaggccgggcaatgcgccggtgtactacccgagcgtcctgctgcgggggctcgacccgtgggaggggcgggggcgggggacgaggagccccgtcgggtggctgcgccaggcgatctccgcctcggagggtgacgtcgtcgccgtcggcggggtcgacgccgccgtctacctcgtcttcctctcctccgtgttgtccatcttggtgttctctgggattgtgctgcttccagttctgctacctgttgctgctactgacgataacctgaacctggagagggccattggcctgaagaacggcaaaacaccccagaacttcacagagctcgagaaattagcactgggcaatgttcaagaacatagccgaaggctgtgggcatttctattatcagtctattgggtctcttttgtcacgtacttcgtactatggaagtcctacaagcatgtttctaatatgagagcggctgcaagatcaacaccagatgttaaaccggaggagtttgctgtgttggtgagagatgttcctaagccacctcctgatcaaactataaaggattctgtagactcatatttccgagcacttcatcctgataccttctacagatcaatggttgtgactgaccacacaaaggctgacaaaatttatcaagagattgaaggtcacaaacagaaaattgctcgtgctgaagttgtctatgcggagtctaaaacaacaggcaagcctgagggcaccaagcctacgcatcggattggatttcttggtcttatcggtaaaaaggttgatacaattgagtattgtaatgaccaaatcaaggagttgctgcccaaactggaggccgaacagaagactacccttcgtgagaaacagcaacaggctgcaattgtgtttttcaacagaagatctgctgcagcttctgcatctcagactctccatgctcagatgtttgataaatggactgttgagcaggctcctgaaccacgccagataatatggtctaatccttccaagaaaatatatgagaggcaaatcagacaggttgtggtctataccattgtctttctcacagtggttttctatatgattcctattactgctatctctgctcttacaactttggagaagttgagggagaagcttccctttctgaaggtggtggtggaccaaccgaaaatcaagactgtcctacaggcttacctcccgtag

SEQ ID NO: 550 - protein, 25 aa, Artificial sequence
  GRF polypeptide ET domain
  misc_feature (2)..(10): Xaa can be any naturally occurring amino acid
  misc_feature (12)..(21): Xaa can be any naturally occurring amino acid
  misc_feature (23)..(24): Xaa can be any naturally occurring amino acid
CXXXXXXXXXCXXXXXXXXXXCXXH

SEQ ID NO: 551 - protein, 107 aa, Artificial sequence
  ZnF protein domain
  misc_feature (2)..(3): Xaa can be any naturally occurring amino acid
  misc_feature (5)..(13): Xaa can be any naturally occurring amino acid
  misc_feature (14)..(43): Xaa can be a gap or any naturally occurring amino acid
  misc_feature (45): Xaa can be any naturally occurring amino acid
  misc_feature (46)..(47): Xaa can be a gap or any naturally occurring amino acid
  misc_feature (49)..(50): Xaa can be any naturally occurring amino acid
  misc_feature (51)..(51): Xaa can be a gap or any naturally occurring amino acid
  misc_feature (53)..(54): Xaa can be any naturally occurring amino acid
  misc_feature (56)..(59): Xaa can be any naturally occurring amino acid
  misc_feature (60)..(103): Xaa can be a gap or any naturally occurring amino acid
  misc_feature (105)..(106): Xaa can be any naturally occurring amino acid
CXXCXXXXXXXXXXXXXXXXXXXXXXXXXXXXXXXXXXXXXXXCXXXHXXXCXXCXXXXXXXXXXXXXXXXXXXXXXXXXXXXXXXXXXXXXXXXXXXXXXXXCXXC

SEQ ID NO: 552 - protein, 22 aa, Artificial sequence
  SYR protein Leucine Zipper motif
  misc_feature (2)..(7): Xaa can be any naturally occurring amino acid
  misc_feature (9)..(14): Xaa can be any naturally occurring amino acid
  misc_feature (16)..(21): Xaa can be any naturally occurring amino acid
LXXXXXXLXXXXXXLXXXXXXL

SEQ ID NO: 553 - protein, 246 aa, Glycine max
MTSASELFHTRRHRLGRNALDLGLDTELHAADSLRQLRLRHYYLRRHHPERASDRIDGRYRRSFVSESVDSEENVRSSLRGSSSERLPVGVVLARARLLQRLRGEPLSTNRQYDRDSFGEDPESESSNEDPSGASLVTELTSQMARSQFLQELSTKPPGLTQEALDCLHQEVFSSNASEIGLDSRVLQDCSICLESFTDGDELIRLPCGHKFHSVCLDPWIRCCGDCPYCRRCIVVNTHSSLNEDE

SEQ ID NO: 554 - protein, 787 aa, Glycine max
MSPWHEPDPYGLSKVRAKDTDLTSPHLIPSMQGQRGTVGSMPETLEFDCGSASGNSTVDQQICWNNVNPAENQIPDYILSPGDMNSSYGNSIINREWQNLSGWSLGEPSSSNTPNEVNNNEQKRELGWSSTITAGALAGPRLEERRLEPANALSLDNVNTGPMYTRSPNSRLMSQNLNLNAGLADNGSDNSQHLELPNLNKSSGSANECIPPNVGSGSFLLPSGNNGFLVEDTDGRPGCSHDTRRVSCKRKAVEGNNGQSSDAGSSSYSQHTDGSAWHTIPTQVNAGSSSRRSISSEQVNARLGLGMGDGASENVPDSNIAGSSESFHRNFRLRLNPSNPPNSVPPTAFSTGSMIRHSGVPPSSQVSQRLHFVDNSLNLRSAPPIDNVVPQSQPLVIHVPALPRNRQSFRWSGGSSSRNIHSSNSVICADRDQQDASSRRMSRNMLEHPVFVPATDLRNLVQNPTVRASSSSSENLSIPGNVASSSRTGSNPATNPSSATTFSRSNPPQHPRRLSEYVRRSLFSPSSDAIGSPSHNYSSLRSGLSTSEPRALSSGSGANPRSASWLERQGDSEFGIPYSLRTLAVASEGGSSRLVSELRNVLGLMRRGGNVRFEGKTAYNIPPPYLRIAKSLWAMGAIMASKLVQSLYRSNSKNIITCPAPMQDVVILDHQSFLSGIADVRDRHRDMRLDVDNMSYEELLALEERIGNVSTGLSEETVLKHLKQRKHSAEKGPQIDAEPCCVCQEDYGDEDDIGTLDCGHDFHSSCIKQWLMHKNLCPICKTTGLAT

SEQ ID NO: 555 - protein, 596 aa, Arabidopsis thaliana
MLLSALLTSVGINLGLCFLFFTLYSILRKQPSNVTVYGPRLVKKDGKSQQSNEFNLERLLPTAGWVKRALEPTNDEILSNLGLDALVFIRVFVFSIRVFSFASVVGIFILLPVNYMGTEFEEFFDLPKKSMDNFSISNVNDGSNKLWIHFCAIYIFTAVVCSLLYYEHKYILTKRIAHLYSSKPQPQEFTVLVSGVPLVSGNSISETVENFFREYHSSSYLSHIVVHRTDKLKVLMNDAEKLYKKLTRVKSGSISRQKSRWGGFLGMFGNNVDVVDHYQKKLDKLEDDMRLKQSLLAGEEVPAAFVSFRTRHGAAIATNIQQGIDPTQWLTEAAPEPEDVHWPFFTASFVRRWISNVVVLVAFVALLILYIVPVVLVQGLANLHQLETWFPFLKGILNMKIVSQVITGYLPSLIFQLFLLIVPPIMLLLSSMQGFISHSQIEKSACIKLLIFTVWNSFFANVLSGSALYRVNVFLEPKTIPRVLAAAVPAQASFFVSYVVTSGWTGLSSEILRLVPLLWSFITKLFGKEDDKEFEVPSTPFCQEIPRILFFGLLGITYFFLSPLILPFLLVYYCLGYIIYRNQVTEPISLLSIILC

SEQ ID NO: 556 - protein, 806 aa, Arabidopsis thaliana
MATLQDIGVSALINLFGAFLFLIAFAVLRIQPINDRVYFPKWYLTGERNSPRRSDRTLVGKFVNLNYKTYFTFLNWMPQAMKMSESEIIRHAGLDSAIFLRIYTLGLKIFAPVMVLALVVLVPVNVSSGTLFFLKKELVVSNIDKLSISNVQPKSSKFFFHIAVEYIFTFWACFMLYREYNNVAIMRLQYLASQRRRPEQFTVVVRNVPDMPGHSVPDTVDQFFKTNHPEHYLCHQAVYNANTYAKLVKQRAKLQRWFDYYVLKHQRNPHKQPTCRTGFLGLWGKRVDSIEYYKQQIKEFDHNMSLERQKVLKDSKLMLPVAFVSFDSRWGAAVCAQTQQSKNPTLWLTSSAPEPRDIYWQNLAIPFISLTIRKLVIGVSVFALVFFYMIPIAFVQSLANLEGLDRVAPFLRPVTRLDFIKSFLQGFLPGLALKIFLWILPTVLLIMSKIEGYIALSTLERRAAAKYYYFMLVNVFLGSIIAGTAFEQLHSFLHQSPSQIPRTIGVSIPMKATFFITYIMVDGWAGIAGEILRLKPLVIFHLKNMFIVKTEEDRVRAMDPGFVDFKETIPSLQLYFLLGIVYTAVTPILLPFILIFFAFAYLVYRHQIINVYNQQYESCGAFWPHVHGRIIASLLISQLLLMGLLASKKAADSTPLLIILPILTLSFHKYCKHRFEPAFRQYPLEEAMAKDKLEKETEPELNMKADLADAYLHPIFHSFEKEVELSSSSSSEKETHQEETPEVRVDKHETQSSSPVTELGTSSHHHHVYNSTSPSSHYASAYEQSSSQYEYHYNTHQYEEHEYRYN

The invention claimed is:

1. A method for increasing seed yield-related traits in a plant relative to a control plant, comprising introducing and expressing in a plant a nucleic acid encoding a Growth-Regulating Factor (GRF) polypeptide, and selecting for a plant having increased seed yield-related traits on the basis of said plant showing increased seed yield-related traits relative to a control plant, wherein said seed yield-related traits comprise increased total seed yield per plant.

2. The method of claim 1, wherein said GRF polypeptide comprises:
   (i) a domain having at least 80% or more amino acid sequence identity to a QLQ domain comprising the amino acid sequence of SEQ ID NO: 115; and
   (ii) a domain having at least 80% or more amino acid sequence identity to a WRC domain comprising the amino acid sequence of SEQ ID NO: 116,
   and has at least 80% or more amino acid sequence identity to the amino acid sequence of SEQ ID NO: 2.

3. The method of claim 1, wherein said GRF polypeptide has at least 90% or more amino acid sequence identity to the amino acid sequence of SEQ ID NO: 2.

4. The method of claim 1, wherein said nucleic acid encoding a GRF polypeptide comprises:
   (a) the nucleotide sequence of SEQ ID NO: 1;
   (b) a nucleotide sequence encoding a polypeptide comprising the amino acid sequence of SEQ ID NO: 2; or
   (c) a nucleotide sequence capable of hybridizing with the nucleotide sequence of (a) or (b) under stringency hybridization conditions comprising hybridization at 50° C. in 4×SSC or at 40° C. in 6×SSC and 50% formamide, followed by washing at 50° C. in 2×SSC.

5. The method of claim 1, wherein said increased seed yield-related traits further comprise one or more of: (i) increased seed filling rate; (ii) increased harvest index; or (iii) increased thousand kernel weight (TKW).

6. The method of claim 1, wherein said nucleic acid is operably linked to a constitutive promoter, a plant constitutive promoter, a GOS2 promoter, or a GOS2 promoter from rice comprising the nucleotide sequence of SEQ ID NO: 117.

7. A plant produced by the method of claim 1, or a plant part, plant cell, seed or progeny of said plant, wherein said plant, or said plant part, plant cell, seed or progeny, comprises a transgene comprising said nucleic acid encoding a Growth-Regulating Factor (GRF) polypeptide operably linked to a constitutive promoter isolated from a plant genome, and wherein said plant is a monocotyledonous plant.

8. A method for making a plant having an increased yield-related trait relative to a control plant, comprising introducing into a plant cell, plant, or part thereof a construct comprising a nucleic acid sequence encoding a GRF polypeptide operably linked to one or more control sequences, and selecting for a plant having increased yield-related traits on the basis of said plant showing increased yield-related traits relative to a control plant, wherein the increased yield-related trait is one or more of: (i) increased early vigour; (ii) increased biomass; (iii) increased total seed yield per plant; (iv) increased seed filling rate; (v) increased harvest index; (vi) increased thousand kernel weight (TKW), (vii) increased abiotic stress resistance, or (viii) increased nutrient uptake efficiency.

9. A method for the production of a transgenic plant having increased seed yield-related traits relative to a control plant, comprising:
   (i) introducing and expressing in a plant, plant part, or plant cell, a nucleic acid encoding a GRF polypeptide under control of a plant constitutive promoter;
   (ii) cultivating the plant cell, plant part, or plant under conditions promoting plant growth and development; and
   (iii) selecting for a transgenic plant having increased seed yield-related traits on the basis of said transgenic plant showing increased seed yield-related traits relative to a control plant,
   wherein said seed yield-related traits comprise increased total seed yield per plant.

10. A transgenic plant having increased seed yield-related traits relative to a control plant resulting from increased expression of a nucleic acid encoding a GRF polypeptide operably linked to a plant constitutive promoter, or a transgenic plant cell or transgenic plant part derived from said transgenic plant, wherein said seed yield-related traits comprise increased total seed yield per plant, and wherein said plant is a monocotyledonous plant.

11. The transgenic plant of claim 10, wherein said plant is a crop plant, a monocot, a cereal, rice, maize, wheat, barley, millet, rye, *triticale, sorghum*, or oats, or a transgenic plant cell derived from said transgenic plant.

12. Harvestable parts, including seed, of the transgenic plant of claim 10, wherein said harvestable parts comprise a transgene comprising the nucleic acid encoding a GRF polypeptide.

13. The method of claim 9, wherein said GRF polypeptide has at least 95% or more amino acid sequence identity to the amino acid sequence of SEQ ID NO: 2.

14. The method of claim 9, wherein the plant is a crop plant, a monocot, or a cereal, or wherein the plant is rice, maize, wheat, barley, millet, rye, *triticale, sorghum*, or oat.

15. The plant of claim 7, wherein the plant is a crop plant or a cereal, or wherein the plant is rice, maize, wheat, barley, millet, rye, *triticale, sorghum*, or oat.

16. The method of claim 8, wherein said GRF polypeptide has at least 95% or more amino acid sequence identity to the amino acid sequence of SEQ ID NO: 2.

17. The method of claim 8, wherein said nucleic acid encoding a GRF polypeptide comprises:
    (a) the nucleotide sequence of SEQ ID NO: 1;
    (b) a nucleotide sequence encoding a polypeptide comprising the amino acid sequence of SEQ ID NO: 2; or
    (c) a nucleotide sequence capable of hybridizing with the nucleotide sequence of (a) or (b) under stringency hybridization conditions comprising hybridization at 50° C. in 4×SSC or at 40° C. in 6×SSC and 50% formamide, followed by washing at 50° C. in 2×SSC.

18. The method of claim 8, wherein one of the control sequences is a plant constitutive promoter, a GOS2 promoter, or a GOS2 promoter comprising the nucleotide sequence of SEQ ID NO: 117.

19. The method of claim 9, wherein said GRF polypeptide has at least 95% or more amino acid sequence identity to the amino acid sequence of SEQ ID NO: 2.

20. The method of claim 9, wherein said nucleic acid encoding a GRF polypeptide comprises:
    (a) the nucleotide sequence of SEQ ID NO: 1;
    (b) a nucleotide sequence encoding a polypeptide comprising the amino acid sequence of SEQ ID NO: 2; or
    (c) a nucleotide sequence capable of hybridizing with the nucleotide sequence of (a) or (b) under stringency hybridization conditions comprising hybridization at 50° C. in 4×SSC or at 40° C. in 6×SSC and 50% formamide, followed by washing at 50° C. in 2×SSC.

21. The method of claim 9, wherein said nucleic acid is operably linked to a constitutive promoter, a plant constitutive promoter, a GOS2 promoter, or a GOS2 promoter from rice comprising the nucleotide sequence of SEQ ID NO: 117.

* * * * *